United States Patent
Dennis et al.

(10) Patent No.: US 11,773,185 B2
(45) Date of Patent: Oct. 3, 2023

(54) ANTI-BACE1 ANTIBODIES AND METHODS OF USE THEREOF

(71) Applicant: Denali Therapeutics Inc., South San Francisco, CA (US)

(72) Inventors: Mark S. Dennis, South San Francisco, CA (US); Jennifer A. Getz, South San Francisco, CA (US); Rinkan Shukla, South San Francisco, CA (US); Adam P. Silverman, South San Francisco, CA (US); Yin Zhang, South San Francisco, CA (US); Joy Yu Zuchero, South San Francisco, CA (US)

(73) Assignee: Denali Therapeutics Inc., South San Francisco, CA (US)

(*) Notice: Subject to any disclaimer, the term of this patent is extended or adjusted under 35 U.S.C. 154(b) by 330 days.

(21) Appl. No.: 16/867,942

(22) Filed: May 6, 2020

(65) Prior Publication Data

US 2021/0070881 A1    Mar. 11, 2021

Related U.S. Application Data

(63) Continuation of application No. PCT/US2018/059850, filed on Nov. 8, 2018.

(60) Provisional application No. 62/765,136, filed on Aug. 16, 2018, provisional application No. 62/583,413, filed on Nov. 8, 2017.

(51) Int. Cl.
| | | |
|---|---|---|
| C07K 16/40 | (2006.01) | |
| A61P 25/28 | (2006.01) | |
| A61K 39/00 | (2006.01) | |

(52) U.S. Cl.
CPC .............. *C07K 16/40* (2013.01); *A61P 25/28* (2018.01); *A61K 2039/505* (2013.01); *C07K 2317/24* (2013.01); *C07K 2317/52* (2013.01); *C07K 2317/526* (2013.01); *C07K 2317/56* (2013.01); *C07K 2317/565* (2013.01); *C07K 2317/92* (2013.01)

(58) Field of Classification Search
None
See application file for complete search history.

(56) References Cited

U.S. PATENT DOCUMENTS

| | | |
|---|---|---|
| 6,221,645 B1 | 4/2001 | Chrysler et al. |
| 7,989,597 B2 | 8/2011 | Chang et al. |
| 8,568,717 B2 | 10/2013 | De et al. |
| 8,772,457 B2 | 7/2014 | Atwal et al. |
| 8,956,614 B2 | 2/2015 | Strooper et al. |
| 9,193,766 B2 | 11/2015 | Lazarus et al. |
| 9,809,647 B2 | 11/2017 | Imai et al. |
| 9,908,943 B2 | 3/2018 | Strooper et al. |
| 10,377,834 B2 | 8/2019 | Strooper et al. |
| 11,370,832 B2 | 6/2022 | Chen et al. |
| 2007/0161091 A1 | 7/2007 | Pompejus et al. |
| 2017/0296618 A1 | 10/2017 | Real et al. |
| 2017/0320912 A1 | 11/2017 | Freskgard et al. |
| 2018/0000964 A1 | 1/2018 | Tan et al. |
| 2018/0002446 A1 | 1/2018 | Adamkewicz et al. |
| 2020/0216522 A1 | 7/2020 | Chen et al. |

FOREIGN PATENT DOCUMENTS

| | | |
|---|---|---|
| EP | 2664625 B1 | 8/2017 |
| WO | 2002101232 A2 | 12/2002 |
| WO | 2010146058 A1 | 12/2010 |
| WO | 2012064836 A1 | 5/2012 |
| WO | 2013177062 A2 | 11/2013 |
| WO | 2015197735 A1 | 12/2015 |
| WO | 2016081639 A1 | 5/2016 |
| WO | 2016081640 A1 | 5/2016 |
| WO | 2016081643 A1 | 5/2016 |
| WO | 2016083425 A1 | 6/2016 |
| WO | 2016083426 A1 | 6/2016 |
| WO | 2016097315 A3 | 8/2016 |
| WO | 2016122968 A1 | 8/2016 |
| WO | 2017016982 A1 | 2/2017 |
| WO | 2017044807 A2 | 3/2017 |
| WO | 2017095250 A1 | 6/2017 |
| WO | 2017158064 A1 | 9/2017 |
| WO | 2017160555 A1 | 9/2017 |
| WO | 2018014864 A1 | 1/2018 |
| WO | 2018152359 A1 | 8/2018 |
| WO | 2019094576 A1 | 5/2019 |

OTHER PUBLICATIONS

Schroeder et al. (J Allergy Clin Immunol 2010, 125:S41-S52).*
Lloyd et al. Protein Engineering, Design & Selection 2009, 22:159-168.*
Rudikoff et al. (Proc Natl Acad Sci USA 1982 vol. 79 p. 1979).*
MacCallum et al. (J. Mol. Biol. 1996 262, 732-745).*
Pascalis et al. (The Journal of Immunology (2002) 169, 3076-3084).*
Casset et al. (BBRC 2003, 307:198-205).*
Vajdos et al. (J. Mol. Biol. (2002) 320, 415-428).*
Chen et al. (J. Mol. Bio. (1999) 293, 865-881).*

(Continued)

*Primary Examiner* — Sharon X Wen
(74) *Attorney, Agent, or Firm* — Kilpatrick Townsend & Stockton LLP

(57) ABSTRACT

In one aspect, antibodies that specifically bind to a human BACE1 protein are provided herein. In some embodiments, the antibodies contain modifications that reduce effector function, extend serum stability or serum half-life, or promote heterodimerization. In other aspects, bispecific antibodies and pharmaceutical compositions comprising antibodies that bind to human BACE1 protein are provided herein. Methods for inhibiting amyloid-β formation and/or aggregation, inhibiting amyloid plaque formation, and treating neurodegenerative diseases are also provided herein.

22 Claims, 7 Drawing Sheets

Specification includes a Sequence Listing.

(56) References Cited

OTHER PUBLICATIONS

Wu et al. (J. Mol. Biol. (1999) 294, 151-162).*
Padlan et al. (PNAS 1989, 86:5938-5942).*
Lamminmaki et al. (JBC 2001, 276:36687-36694).*
Piche-Nicholas et al. MABS 2018, 10:81-94.*
"Takeda R&D Investor Days 2018", Oct. 2018, XP055558399, Retrieved from the Internet: URL:http://www.takeda.de/siteassets/system/investors/report/quarterlyannouncements/fy2018/0_full_deck_boston_e.pdf [retrieved on Feb. 18, 2019] p. 77.
Atwal Jasvinder et al., "A therapeutic antibody targeting BACE1 inhibits amyloid-[beta] production in vivo" Science Translational Medicine, vol. 3, No. 84, May 25, 2011.
Campagna et al., "Evaluation of an Allosteric BACE Inhibitor Peptide to Identify Mimetics that Can Interact with the Loop F Region of the Enzyme and Prevent APP Cleavage," Journal of molecular biology 430(11):1566-76, 2018.
International Search Report and Written Opinion for International Appl. No. PCT/US2018/059850, 17 pages.
International Search Report and Written Opinion for International Appl No. PCT/US2018/059801, 23 pages.
Invitation to Pay Additional Fees and, Where Applicable, Protest Fee for International Appl. No. PCT/US2018/059801, 14 pages.
L. Zhou et al., "Inhibition of beta-Secretase in Vivo via Antibody Binding to Unique Loops (D and F) of Bace" Journal of Biological Chemistry, vol. 286, No. 10, Mar. 11, 2011, pp. 8677-8687.
Panka, et al., "Variable Region Framework Differences Result in Decreased or Increased Affinity of Variant Anti-Digoxin Antibodies", Proceedings of The National Academy of Science, vol. 85, No. 9, pp. 3080-3084.
Ruderisch et al., "Potent and Selective BACE-1 Peptide Inhibitors Lower Aβ Levels Mediated by Brain Shuttle Transport" EBioMedicine 24:76-92 (2017).
Rudikoff, et al., "Single Amino Acid Substitution Altering Antigen-Binding Specificity", Proceedings of the National Academy of Sciences, Immunology, vol. 79, No. 6, Mar. 1982, pp. 1979-1983.
Y. J. Yu et al., "Therapeutic bispecific antibodies cross the blood-brain barrier in nonhuman primates" Science Translational Medicine, vol. 6, No. 261, Nov. 5, 2014, pp. 261ra154-261ra 154.
Yadav et al., Widespread brain distribution and activity following i.c.v. infusion of anti-β-secretase (BACE1) in nonhuman primates, Br. J. Pharm. (2017) 174(22):4173-4185.

* cited by examiner

ANTI-BACE1 ANTIBODIES AND METHODS OF USE THEREOF

CROSS-REFERENCE TO RELATED APPLICATIONS

The present application is a continuation of International Application No. PCT/US2018/059850, filed Nov. 8, 2018, which claims priority to U.S. Provisional Application No. 62/765,136, filed on Aug. 16, 2018, and U.S. Provisional Application No. 62/583,413, filed on Nov. 8, 2017, the disclosures of which are incorporated herein by reference in their entirety for all purposes.

SEQUENCE LISTING

The instant application contains a Sequence Listing which has been submitted electronically in ASCII format and is hereby incorporated by reference in its entirety. Said ASCII copy, created on Oct. 31, 2018, is named 102342-001620US-1189437_SL.TXT and is 858,033 bytes in size.

BACKGROUND

Protein and peptide aggregation is a common feature in a number of neurodegenerative diseases, including Alzheimer's disease and frontotemporal dementia. The aggregation of amyloid-beta (Aβ) peptide into senile plaques is a primary marker of Alzheimer's disease. Aβ peptides are derived from amyloid precursor protein (APP), a transmembrane protein that is sequentially cleaved by proteases. APP is first cleaved at an N-terminal region by beta-secretase 1 (BACE1) to yield a soluble N-terminal product and a membrane-bound C-terminal product, which is then cleaved by gamma-secretase to produce Aβ. It is believed that accumulation of Aβ peptides and senile plaque formation may be due to the abnormal production and clearance of Aβ peptides in the brain.

Accordingly, there remains a need for therapeutic agents that target Aβ peptide production or aggregation.

SUMMARY

In one aspect, antibodies (or antigen-binding portions thereof) that specifically bind to a human beta-secretase 1 (BACE1) protein are provided. In some embodiments, the antibody or antigen-binding portion thereof recognizes an epitope that is the same or substantially the same as the epitope recognized by antibody clone 3G10, 2E1, 1B4, 1A12, 1D7, 1A5, 1H6, 4H10, 3C11, 4A4, 1D2, 2G7, 5A4, 1B1, 1F1, 106, 1F7, 1D10, 4B1, 1F8, 2B8, 1E7, or 2H8.

In some embodiments, the antibody or antigen-binding portion thereof comprises one or more complementarity determining regions (CDRs) selected from the group consisting of: (a) a heavy chain CDR1 (CDR-H1) having at least 90% sequence identity to the amino acid sequence of any one of SEQ ID NOs:29-50, 409-414, and 433-434, or having up to two amino acid substitutions relative to the amino acid sequence of any one of SEQ ID NOs:29-50, 409-414, and 433-434; (b) a heavy chain CDR2 (CDR-H2) having at least 90% sequence identity to the amino acid sequence of any one of SEQ ID NOs:51-77, 415-422, and 435-436, or having up to two amino acid substitutions relative to the amino acid sequence of any one of SEQ ID NOs:51-77, 415-422, and 435-436; (c) a heavy chain CDR3 (CDR-H3) having at least 90% sequence identity to the amino acid sequence of any one of SEQ ID NOs:78-100, 178, 423-429 and 466, or having up to two amino acid substitutions relative to the amino acid sequence of any one of SEQ ID NOs:78-100, 178, 423-429, and 466; (d) a light chain CDR1 (CDR-L1) having at least 90% sequence identity to the amino acid sequence of any one of SEQ ID NOs:129-144, 179-181, 393-394, and 467-469, or having up to two amino acid substitutions relative to the amino acid sequence of any one of SEQ ID NOs:129-144, 179-181, 393-394, and 467-469; (e) a light chain CDR2 (CDR-L2) having at least 90% sequence identity to the amino acid sequence of any one of SEQ ID NOs:145-157, 182, 395-402, 430-431, and 470, or having up to two amino acid substitutions relative to the amino acid sequence of any one of SEQ ID NOs:145-157, 182, 395-402, 430-431, and 470; and (f) a light chain CDR3 (CDR-L3) having at least 90% sequence identity to the amino acid sequence of any one of SEQ ID NOs:158-177, 403-408, and 432, or having up to two amino acid substitutions relative to the amino acid sequence of any one of SEQ ID NOs:158-177, 403-408, and 432.

In some embodiments, the antibody or antigen-binding portion thereof comprises one or more CDRs selected from the group consisting of: (a) a CDR-H1 comprising the amino acid sequence of any one of SEQ ID NOs:29-50, 409-414, and 433-434; (b) a CDR-H2 comprising the amino acid sequence of any one of SEQ ID NOs:51-77, 415-422, and 435-436; (c) a CDR-H3 comprising the amino acid sequence of any one of SEQ ID NOs:78-100, 178, 423-429, and 466; (d) a CDR-L1 comprising the amino acid sequence of any one of SEQ ID NOs:129-144, 179-181, 393-394, and 467-469; (e) a CDR-L2 comprising the amino acid sequence of any one of SEQ ID NOs:145-157, 182, 395-402, 430-431, and 470; and (f) a CDR-L3 comprising the amino acid sequence of any one of SEQ ID NOs:158-177, 403-408, and 432.

In some embodiments, the antibody or antigen-binding portion thereof comprises: (a) a CDR-H1, CDR-H2, CDR-H3, CDR-L1, CDR-L2, and CDR-L3 comprising the amino acid sequences of SEQ ID NOs:29, 51, 78, 129, 145, and 158, respectively; or (b) a CDR-H1, CDR-H2, CDR-H3, CDR-L1, CDR-L2, and CDR-L3 comprising the amino acid sequences of SEQ ID NOs:30, 52, 79, 130, 146, and 159, respectively; or (c) a CDR-H1, CDR-H2, CDR-H3, CDR-L1, CDR-L2, and CDR-L3 comprising the amino acid sequences of SEQ ID NOs:31, 53, 80, 131, 147, and 160, respectively; or (d) a CDR-H1, CDR-H2, CDR-H3, CDR-L1, CDR-L2, and CDR-L3 comprising the amino acid sequences of SEQ ID NOs:32, 54, 81, 132, 148, and 161, respectively; or (e) a CDR-H1, CDR-H2, CDR-H3, CDR-L1, CDR-L2, and CDR-L3 comprising the amino acid sequences of SEQ ID NOs:33, 55, 82, 133, 147, and 162, respectively; or (f) a CDR-H1, CDR-H2, CDR-H3, CDR-L1, CDR-L2, and CDR-L3 comprising the amino acid sequences of SEQ ID NOs:34, 56, 83, 134, 149, and 163, respectively; or (g) a CDR-H1, CDR-H2, CDR-H3, CDR-L1, CDR-L2, and CDR-L3 comprising the amino acid sequences of SEQ ID NOs:35, 57, 84, 135, 148, and 164, respectively; or (h) a CDR-H1, CDR-H2, CDR-H3, CDR-L1, CDR-L2, and CDR-L3 comprising the amino acid sequences of SEQ ID NOs:36, 58, 85, 136, 150, and 165, respectively; or (i) a CDR-H1, CDR-H2, CDR-H3, CDR-L1, CDR-L2, and CDR-L3 comprising the amino acid sequences of SEQ ID NOs:37, 59, 86, 137, 151, and 159, respectively; or (j) a CDR-H1, CDR-H2, CDR-H3, CDR-L1, CDR-L2, and CDR-L3 comprising the amino acid sequences of SEQ ID NOs:38, 60, 87, 133, 147, and 166, respectively; or (k) a CDR-H1, CDR-H2, CDR-H3, CDR-L1, CDR-L2, and CDR-L3 comprising the amino acid sequences of SEQ ID NOs:36, 61, 88, 138, 150, and 167, respectively; or (l) a CDR-H1, CDR-H2, CDR-H3, CDR-L1, CDR-L2, and CDR-L3 comprising the amino acid sequences of SEQ ID NOs:39, 62, 89, 138, 152, and 168, respectively; or (m) a CDR-H1, CDR-H2, CDR-H3, CDR-L1, CDR-L2, and CDR-L3 comprising the amino acid sequences of SEQ ID NOs:40, 63, 90, 138, 153, and 169, respectively; or (n) a CDR-H1, CDR-H2, CDR-H3, CDR-L1, CDR-L2, and CDR-L3 comprising the amino acid sequences of SEQ ID NOs:41, 64, 91, 138, 152, and 170, respectively; or (o) a CDR-H1, CDR-H2, CDR-H3, CDR-L1, CDR-L2, and CDR-L3 comprising the amino acid sequences of SEQ ID NOs:42, 65, 92, 139, 148, and 171, respectively; or (p) a CDR-H1, CDR-H2, CDR-H3, CDR-L1, CDR-L2, and CDR-L3 comprising the amino acid sequences of SEQ ID NOs:34, 66, 93, 134, 149, and 172, respectively; or (q) a CDR-H1, CDR-H2, CDR-H3, CDR-L1, CDR-L2, and CDR-L3 comprising the amino acid sequences of SEQ ID NOs:43, 67, 94, 140, 154, and 173, respectively; or (r) a CDR-H1, CDR-H2, CDR-H3, CDR-L1, CDR-L2, and CDR-L3 comprising the amino acid sequences of SEQ ID NOs:44, 68, 95, 141, 155, and 174, respectively; or (s) a CDR-H1, CDR-H2, CDR-H3, CDR-L1, CDR-L2, and CDR-L3 comprising the amino acid sequences of SEQ ID NOs:45, 69, 96, 142, 156, and 175, respectively; or (t) a CDR-H1, CDR-H2, CDR-H3, CDR-L1, CDR-L2, and CDR-L3 comprising the amino acid sequences of SEQ ID NOs:45, 70, 97, 138, 152, and 168, respectively; or (u) a CDR-H1, CDR-H2, CDR-H3, CDR-L1, CDR-L2, and CDR-L3 comprising the amino acid sequences of SEQ ID NOs:46, 71, 98, 138, 152, and 176, respectively; or (v) a CDR-H1, CDR-H2, CDR-H3, CDR-L1, CDR-L2, and CDR-L3 comprising the amino acid sequences of SEQ ID NOs:45, 71, 98, 138, 152, and 170, respectively; or (w) a CDR-H1, CDR-H2, CDR-H3, CDR-L1, CDR-L2, and CDR-L3 comprising the amino acid sequences of SEQ ID NOs:47, 72, 99, 143, 146, and 159, respectively; or (x) a CDR-H1, CDR-H2, CDR-H3, CDR-L1, CDR-L2, and CDR-L3 comprising the amino acid sequences of SEQ ID NOs:50, 77, 100, 144, 146, and 159, respectively; or (y) a CDR-H1, CDR-H2, CDR-H3, CDR-L1, CDR-L2, and CDR-L3 comprising the amino acid sequences of SEQ ID NOs:47, 416, 425, 143, 395, and 405, respectively; or (z) a CDR-H1, CDR-H2, CDR-H3, CDR-L1, CDR-L2, and CDR-L3 comprising the amino acid sequences of SEQ ID NOs:47, 420, 425, 143, 395, and 405, respectively.

In some embodiments, the antibody or antigen-binding portion thereof comprises: (a) a CDR-H1 comprising the amino acid sequence of any one of SEQ ID NOs:47-50, 409-414, and 433-434; (b) a CDR-H2 comprising the amino acid sequence of any one of SEQ ID NOs:72-77, 415-422, and 435-436; (c) a CDR-H3 comprising the amino acid sequence of any one of SEQ ID NOs:99-100, and 423-429; (d) a CDR-L1 comprising the amino acid sequence of any one of SEQ ID NOs:130, 138, 143-144, and 393-394; (e) a CDR-L2 comprising the amino acid sequence of any one of SEQ ID NOs:146, 152, 157, 395-402, and 430-431; and (f) a CDR-L3 comprising the amino acid sequence of any one of SEQ ID NOs:159, 167, 177, 403-408, and 432.

In some embodiments, the antibody or antigen-binding portion thereof comprises a heavy chain variable region comprising an amino acid sequence that has at least 90% sequence identity to any one of SEQ ID NOs:1-28, 310-315, 448-462, and 464-465. In some embodiments, the antibody or antigen-binding portion thereof comprises a light chain variable region comprising an amino acid sequence that has at least 90% sequence identity to any one of SEQ ID NOs:101-128, 316-320, 437-447, and 463.

In some embodiments, the antibody or antigen-binding portion thereof comprises: (a) a heavy chain variable region comprising an amino acid sequence that has at least 90% sequence identity to any one of SEQ ID NOs:1-28, 310-315, 448-462, and 464-465; and (b) a light chain variable region comprising an amino acid sequence that has at least 90% sequence identity to any one of SEQ ID NOs:101-128, 316-320, 437-447, and 463.

In some embodiments, the antibody or antigen-binding portion thereof comprises: (a) a heavy chain variable region comprising an amino acid sequence that has at least 90% sequence identity to SEQ ID NO:1 and a light chain variable region comprising an amino acid sequence that has at least 90% sequence identity to SEQ ID NO:101; or (b) a heavy chain variable region comprising an amino acid sequence that has at least 90% sequence identity to SEQ ID NO:2 and a light chain variable region comprising an amino acid sequence that has at least 90% sequence identity to SEQ ID NO:102; or (c) a heavy chain variable region comprising an amino acid sequence that has at least 90% sequence identity to SEQ ID NO:3 and a light chain variable region comprising an amino acid sequence that has at least 90% sequence identity to SEQ ID NO:103; or (d) a heavy chain variable region comprising an amino acid sequence that has at least 90% sequence identity to SEQ ID NO:4 and a light chain variable region comprising an amino acid sequence that has at least 90% sequence identity to SEQ ID NO:104; or (e) a heavy chain variable region comprising an amino acid sequence that has at least 90% sequence identity to SEQ ID NO:5 and a light chain variable region comprising an amino acid sequence that has at least 90% sequence identity to SEQ ID NO:105; or (f) a heavy chain variable region comprising an amino acid sequence that has at least 90% sequence identity to SEQ ID NO:6 and a light chain variable region comprising an amino acid sequence that has at least 90% sequence identity to SEQ ID NO:106; or (g) a heavy chain variable region comprising an amino acid sequence that has at least 90% sequence identity to SEQ ID NO:7 and a light chain variable region comprising an amino acid sequence that has at least 90% sequence identity to SEQ ID NO:107; or (h) a heavy chain variable region comprising an amino acid sequence that has at least 90% sequence identity to SEQ ID NO:8 and a light chain variable region comprising an amino acid sequence that has at least 90% sequence identity to SEQ ID NO:108; or (i) a heavy chain variable region comprising an amino acid sequence that has at least 90% sequence identity to SEQ ID NO:9 and a light chain variable region comprising an amino acid sequence that has at least 90% sequence identity to SEQ ID NO:109; or (j) a heavy chain variable region comprising an amino acid sequence that has at least 90% sequence identity to SEQ ID NO:10 and a light chain variable region comprising an amino acid sequence that has at least 90% sequence identity to SEQ ID NO:110; or (k) a heavy chain variable region comprising an amino acid sequence that has at least 90% sequence identity to SEQ ID NO:11 and a light chain variable region comprising an amino acid sequence that has at least 90% sequence identity to SEQ ID NO:111; or (l) a heavy chain variable region comprising an amino acid sequence that has at least 90% sequence identity to SEQ ID NO:12 and a light chain variable region comprising an amino acid sequence that has at least 90% sequence identity to SEQ ID NO:112; or (m) a heavy chain variable region comprising an amino acid sequence that has at least 90% sequence identity to SEQ ID NO:13 and a light chain variable region comprising an amino acid sequence that has at least 90% sequence identity to SEQ ID NO:113; or (n) a heavy chain variable region comprising an amino acid sequence that has at least 90% sequence identity to SEQ ID NO:14 and a light chain variable region comprising an amino acid sequence that has at least 90% sequence identity to SEQ ID NO:114; or (o) a heavy chain variable region comprising an amino acid sequence that has at least 90% sequence identity to SEQ ID NO:15 and a light chain variable region comprising an amino acid sequence that has at least 90% sequence identity to SEQ ID NO:115; or (p) a heavy chain variable region comprising an amino acid sequence that has at least 90% sequence identity to SEQ ID NO:16 and a light chain variable region comprising an amino acid sequence that has at least 90% sequence identity to SEQ ID NO:116; or (q) a heavy chain variable region comprising an amino acid sequence that has at least 90% sequence identity to SEQ ID NO:17 and a light chain variable region comprising an amino acid sequence that has at least 90% sequence identity to SEQ ID NO:117; or (r) a heavy chain variable region comprising an amino acid sequence that has at least 90% sequence identity to SEQ ID NO:18 and a light chain variable region comprising an amino acid sequence that has at least 90% sequence identity to SEQ ID NO:118; or (s) a heavy chain variable region comprising an amino acid sequence that has at least 90% sequence identity to SEQ ID NO:19 and a light chain variable region comprising an amino acid sequence that has at least 90% sequence identity to SEQ ID NO:119; or (t) a heavy chain variable region comprising an amino acid sequence that has at least 90% sequence identity to SEQ ID NO:20 and a light chain variable region comprising an amino acid sequence that has at least 90% sequence identity to SEQ ID NO:120; or (u) a heavy chain variable region comprising an amino acid sequence that has at least 90% sequence identity to SEQ ID NO:21 and a light chain variable region comprising an amino acid sequence that has at least 90% sequence identity to SEQ ID NO:121; or (v) a heavy chain variable region comprising an amino acid sequence that has at least 90% sequence identity to SEQ ID NO:22 and a light chain variable region comprising an amino acid sequence that has at least 90% sequence identity to SEQ ID NO:114; or (w) a heavy chain variable region comprising an amino acid sequence that has at least 90% sequence identity to SEQ ID NO:23 and a light chain variable region comprising an amino acid sequence that has at least 90% sequence identity to SEQ ID NO:122; or (x) a heavy chain variable region comprising an amino acid sequence that has at least 90% sequence identity to SEQ ID NO:28 and a light chain variable region comprising an amino acid sequence that has at least 90% sequence identity to SEQ ID NO:128; or (y) a heavy chain variable region comprising an amino acid sequence that has at least 90% sequence identity to SEQ ID NO:464 and a light chain variable region comprising an amino acid sequence that has at least 90% sequence identity to SEQ ID NO:463; or (z) a heavy chain variable region comprising an amino acid sequence that has at least 90% sequence identity to SEQ ID NO:465 and a light chain variable region comprising an amino acid sequence that has at least 90% sequence identity to SEQ ID NO:463.

In some embodiments, the antibody or antigen-binding portion thereof comprises: (a) a heavy chain variable region comprising an amino acid sequence that has at least 90% sequence identity to any one of SEQ ID NOs:23-28, 310-315, 448-462, and 464-465; and (b) a light chain variable region comprising an amino acid sequence that has at least 90% sequence identity to any one of SEQ ID NOs:122-128, 316-320, 437-447, and 463.

In some embodiments, the antibody or antigen-binding portion thereof comprises: (a) a heavy chain variable region comprising (i) an amino acid sequence that has at least 75% sequence identity to SEQ ID NO:1, and (ii) a CDR-H1, CDR-H2, and CDR-H3 that is identical to SEQ ID NOs:29, 51, and 78, respectively; or (b) a heavy chain variable region comprising (i) an amino acid sequence that has at least 75% sequence identity to SEQ ID NO:2, and (ii) a CDR-H1, CDR-H2, and CDR-H3 that is identical to SEQ ID NOs:30, 52, and 79, respectively; or (c) a heavy chain variable region comprising (i) an amino acid sequence that has at least 75% sequence identity to SEQ ID NO:3, and (ii) a CDR-H1, CDR-H2, and CDR-H3 that is identical to SEQ ID NOs:31, 53, and 80, respectively; or (d) a heavy chain variable region comprising (i) an amino acid sequence that has at least 75% sequence identity to SEQ ID NO:4, and (ii) a CDR-H1, CDR-H2, and CDR-H3 that is identical to SEQ ID NOs:32, 54, and 81, respectively; or (e) a heavy chain variable region comprising (i) an amino acid sequence that has at least 75% sequence identity to SEQ ID NO:5, and (ii) a CDR-H1, CDR-H2, and CDR-H3 that is identical to SEQ ID NOs:33, 55, and 82, respectively; or (f) a heavy chain variable region comprising (i) an amino acid sequence that has at least 75% sequence identity to SEQ ID NO:6, and (ii) a CDR-H1, CDR-H2, and CDR-H3 that is identical to SEQ ID NOs:34, 56, and 83, respectively; or (g) a heavy chain variable region comprising (i) an amino acid sequence that has at least 75% sequence identity to SEQ ID NO:7, and (ii) a CDR-H1, CDR-H2, and CDR-H3 that is identical to SEQ ID NOs:35, 57, and 84, respectively; or (h) a heavy chain variable region comprising (i) an amino acid sequence that has at least 75% sequence identity to SEQ ID NO:8, and (ii) a CDR-H1, CDR-H2, and CDR-H3 that is identical to SEQ ID NOs:36, 58, and 85, respectively; or (i) a heavy chain variable region comprising (i) an amino acid sequence that has at least 75% sequence identity to SEQ ID NO:9, and (ii) a CDR-H1, CDR-H2, and CDR-H3 that is identical to SEQ ID NOs:37, 59, and 86, respectively; or (j) a heavy chain variable region comprising (i) an amino acid sequence that has at least 75% sequence identity to SEQ ID NO:10, and (ii) a CDR-H1, CDR-H2, and CDR-H3 that is identical to SEQ ID NOs:38, 60, and 87, respectively; or (k) a heavy chain variable region comprising (i) an amino acid sequence that has at least 75% sequence identity to SEQ ID NO:11, and (ii) a CDR-H1, CDR-H2, and CDR-H3 that is identical to SEQ ID NOs:36, 61, and 88, respectively; or (l) a heavy chain variable region comprising (i) an amino acid sequence that has at least 75% sequence identity to SEQ ID NO:12, and (ii) a CDR-H1, CDR-H2, and CDR-H3 that is identical to SEQ ID NOs:39, 62, and 89, respectively; or (m) a heavy chain variable region comprising (i) an amino acid sequence that has at least 75% sequence identity to SEQ ID NO:13, and (ii) a CDR-H1, CDR-H2, and CDR-H3 that is identical to SEQ ID NOs:40, 63, and 90, respectively; or (n) a heavy chain variable region comprising (i) an amino acid sequence that has at least 75% sequence identity to SEQ ID NO:14, and (ii) a CDR-H1, CDR-H2, and CDR-H3 that is identical to SEQ ID NOs:41, 64, and 91, respectively; or (o) a heavy chain variable region comprising (i) an amino acid sequence that has at least 75% sequence identity to SEQ ID NO:15, and (ii) a CDR-H1, CDR-H2, and CDR-H3 that is identical to SEQ ID NOs:42, 65, and 92, respectively; or (p) a heavy chain variable region comprising (i) an amino acid sequence that has at least 75% sequence identity to SEQ ID NO:16, and (ii)

a CDR-H1, CDR-H2, and CDR-H3 that is identical to SEQ ID NOs:34, 66, and 93, respectively; or (q) a heavy chain variable region comprising (i) an amino acid sequence that has at least 75% sequence identity to SEQ ID NO:17, and (ii) a CDR-H1, CDR-H2, and CDR-H3 that is identical to SEQ ID NOs:43, 67, and 94, respectively; or (r) a heavy chain variable region comprising (i) an amino acid sequence that has at least 75% sequence identity to SEQ ID NO:18, and (ii) a CDR-H1, CDR-H2, and CDR-H3 that is identical to SEQ ID NOs:44, 68, and 95, respectively; or (s) a heavy chain variable region comprising (i) an amino acid sequence that has at least 75% sequence identity to SEQ ID NO:19, and (ii) a CDR-H1, CDR-H2, and CDR-H3 that is identical to SEQ ID NOs:45, 69, and 96, respectively; or (t) a heavy chain variable region comprising (i) an amino acid sequence that has at least 75% sequence identity to SEQ ID NO:20, and (ii) a CDR-H1, CDR-H2, and CDR-H3 that is identical to SEQ ID NOs:45, 70, and 97, respectively; or (u) a heavy chain variable region comprising (i) an amino acid sequence that has at least 75% sequence identity to SEQ ID NO:21, and (ii) a CDR-H1, CDR-H2, and CDR-H3 that is identical to SEQ ID NOs:46, 71, and 98, respectively; or (v) a heavy chain variable region comprising (i) an amino acid sequence that has at least 75% sequence identity to SEQ ID NO:22, and (ii) a CDR-H1, CDR-H2, and CDR-H3 that is identical to SEQ ID NOs:45, 71, and 98, respectively; or (w) a heavy chain variable region comprising (i) an amino acid sequence that has at least 75% sequence identity to SEQ ID NO:23, and (ii) a CDR-H1, CDR-H2, and CDR-H3 that is identical to SEQ ID NOs:47, 72, and 99, respectively; or (x) a heavy chain variable region comprising (i) an amino acid sequence that has at least 75% sequence identity to SEQ ID NO:24, and (ii) a CDR-H1, CDR-H2, and CDR-H3 that is identical to SEQ ID NOs:48, 73, and 99, respectively; or (y) a heavy chain variable region comprising (i) an amino acid sequence that has at least 75% sequence identity to SEQ ID NO:25, and (ii) a CDR-H1, CDR-H2, and CDR-H3 that is identical to SEQ ID NOs:49, 74, and 99, respectively; or (z) a heavy chain variable region comprising (i) an amino acid sequence that has at least 75% sequence identity to SEQ ID NO:26, and (ii) a CDR-H1, CDR-H2, and CDR-H3 that is identical to SEQ ID NOs:48, 75, and 99, respectively; or (aa) a heavy chain variable region comprising (i) an amino acid sequence that has at least 75% sequence identity to SEQ ID NO:27, and (ii) a CDR-H1, CDR-H2, and CDR-H3 that is identical to SEQ ID NOs:48, 76, and 99, respectively; or (ab) a heavy chain variable region comprising (i) an amino acid sequence that has at least 75% sequence identity to SEQ ID NO:28, and (ii) a CDR-H1, CDR-H2, and CDR-H3 that is identical to SEQ ID NOs:50, 77, and 100, respectively; or (ac) a heavy chain variable region comprising (i) an amino acid sequence that has at least 75% sequence identity to SEQ ID NO:310, and (ii) a CDR-H1, CDR-H2, and CDR-H3 that is identical to SEQ ID NOs:47, 72, and 99, respectively; or (ad) a heavy chain variable region comprising (i) an amino acid sequence that has at least 75% sequence identity to SEQ ID NO:311, and (ii) a CDR-H1, CDR-H2, and CDR-H3 that is identical to SEQ ID NOs:47, 72, and 99, respectively; or (ae) a heavy chain variable region comprising (i) an amino acid sequence that has at least 75% sequence identity to SEQ ID NO:312, and (ii) a CDR-H1, CDR-H2, and CDR-H3 that is identical to SEQ ID NOs:47, 72, and 99, respectively; or (af) a heavy chain variable region comprising (i) an amino acid sequence that has at least 75% sequence identity to SEQ ID NO:313, and (ii) a CDR-H1, CDR-H2, and CDR-H3 that is identical to SEQ ID NOs:47, 72, and 99, respectively; or (ag) a heavy chain variable region comprising (i) an amino acid sequence that has at least 75% sequence identity to SEQ ID NO:314, and (ii) a CDR-H1, CDR-H2, and CDR-H3 that is identical to SEQ ID NOs:47, 72, and 99, respectively; or (ah) a heavy chain variable region comprising (i) an amino acid sequence that has at least 75% sequence identity to SEQ ID NO:315, and (ii) a CDR-H1, CDR-H2, and CDR-H3 that is identical to SEQ ID NOs:47, 72, and 99, respectively; or (ai) a heavy chain variable region comprising (i) an amino acid sequence that has at least 75% sequence identity to SEQ ID NO:448, and (ii) a CDR-H1, CDR-H2, and CDR-H3 that is identical to SEQ ID NOs:409, 72, and 99, respectively; or (aj) a heavy chain variable region comprising (i) an amino acid sequence that has at least 75% sequence identity to SEQ ID NO:449, and (ii) a CDR-H1, CDR-H2, and CDR-H3 that is identical to SEQ ID NOs:410, 72, and 99, respectively; or (ak) a heavy chain variable region comprising (i) an amino acid sequence that has at least 75% sequence identity to SEQ ID NO:450, and (ii) a CDR-H1, CDR-H2, and CDR-H3 that is identical to SEQ ID NOs:411, 72, and 99, respectively; or (al) a heavy chain variable region comprising (i) an amino acid sequence that has at least 75% sequence identity to SEQ ID NO:451, and (ii) a CDR-H1, CDR-H2, and CDR-H3 that is identical to SEQ ID NOs:412, 72, and 99, respectively; or (am) a heavy chain variable region comprising (i) an amino acid sequence that has at least 75% sequence identity to SEQ ID NO:452, and (ii) a CDR-H1, CDR-H2, and CDR-H3 that is identical to SEQ ID NOs:47, 415, and 99, respectively; or (an) a heavy chain variable region comprising (i) an amino acid sequence that has at least 75% sequence identity to SEQ ID NO:453, and (ii) a CDR-H1, CDR-H2, and CDR-H3 that is identical to SEQ ID NOs:47, 416, and 99, respectively; or (ao) a heavy chain variable region comprising (i) an amino acid sequence that has at least 75% sequence identity to SEQ ID NO:454, and (ii) a CDR-H1, CDR-H2, and CDR-H3 that is identical to SEQ ID NOs:47, 417, and 99, respectively; or (ap) a heavy chain variable region comprising (i) an amino acid sequence that has at least 75% sequence identity to SEQ ID NO:455, and (ii) a CDR-H1, CDR-H2, and CDR-H3 that is identical to SEQ ID NOs:47, 418, and 99, respectively; or (aq) a heavy chain variable region comprising (i) an amino acid sequence that has at least 75% sequence identity to SEQ ID NO:456, and (ii) a CDR-H1, CDR-H2, and CDR-H3 that is identical to SEQ ID NOs:47, 419, and 99, respectively; or (ar) a heavy chain variable region comprising (i) an amino acid sequence that has at least 75% sequence identity to SEQ ID NO:457, and (ii) a CDR-H1, CDR-H2, and CDR-H3 that is identical to SEQ ID NOs:47, 72, and 100, respectively; or (as) a heavy chain variable region comprising (i) an amino acid sequence that has at least 75% sequence identity to SEQ ID NO:458, and (ii) a CDR-H1, CDR-H2, and CDR-H3 that is identical to SEQ ID NOs:47, 72, and 423, respectively; or (at) a heavy chain variable region comprising (i) an amino acid sequence that has at least 75% sequence identity to SEQ ID NO:459, and (ii) a CDR-H1, CDR-H2, and CDR-H3 that is identical to SEQ ID NOs:47, 72, and 424, respectively; or (au) a heavy chain variable region comprising (i) an amino acid sequence that has at least 75% sequence identity to SEQ ID NO:460, and (ii) a CDR-H1, CDR-H2, and CDR-H3 that is identical to SEQ ID NOs:47, 72, and 425, respectively; or (av) a heavy chain variable region comprising (i) an amino acid sequence that has at least 75% sequence identity to SEQ ID NO:461, and (ii) a CDR-H1, CDR-H2, and CDR-H3 that is identical to SEQ ID NOs:47, 72, and 426, respectively; or (aw) a heavy chain variable region comprising (i) an amino acid sequence that has at least 75% sequence identity to SEQ ID NO:462, and (ii) a CDR-H1, CDR-H2, and CDR-H3 that is identical to SEQ ID NOs:47, 72, and 427, respectively; or (ax) a heavy chain variable region comprising (i) an amino acid sequence that has at least 75% sequence identity to SEQ ID NO:464, and (ii) a CDR-H1, CDR-H2, and CDR-H3 that is identical to SEQ ID NOs:47, 416, and 425, respectively; or (ay) a heavy chain variable region comprising (i) an amino acid sequence that has at least 75% sequence identity to SEQ ID NO:465, and (ii) a CDR-H1, CDR-H2, and CDR-H3 that is identical to SEQ ID NOs:47, 420, and 425, respectively.

In some embodiments, the antibody or antigen-binding portion thereof comprises: (a) a light chain variable region comprising (i) an amino acid sequence that has at least 75% sequence identity to SEQ ID NO:101, and (ii) a CDR-L1, CDR-L2, and CDR-L3 that is identical to SEQ ID NOs:129, 145, and 158, respectively; or (b) a light chain variable region comprising (i) an amino acid sequence that has at least 75% sequence identity to SEQ ID NO:102, and (ii) a CDR-L1, CDR-L2, and CDR-L3 that is identical to SEQ ID NOs:130, 146, and 159, respectively; or (c) a light chain variable region comprising (i) an amino acid sequence that has at least 75% sequence identity to SEQ ID NO:103, and (ii) a CDR-L1, CDR-L2, and CDR-L3 that is identical to SEQ ID NOs:131, 147, and 160, respectively; or (d) a light chain variable region comprising (i) an amino acid sequence that has at least 75% sequence identity to SEQ ID NO:104, and (ii) a CDR-L1, CDR-L2, and CDR-L3 that is identical to SEQ ID NOs:132, 148, and 161, respectively; or (e) a light chain variable region comprising (i) an amino acid sequence that has at least 75% sequence identity to SEQ ID NO:105, and (ii) a CDR-L1, CDR-L2, and CDR-L3 that is identical to SEQ ID NOs:133, 147, and 162, respectively; or (f) a light chain variable region comprising (i) an amino acid sequence that has at least 75% sequence identity to SEQ ID NO:106, and (ii) a CDR-L1, CDR-L2, and CDR-L3 that is identical to SEQ ID NOs:134, 149, and 163, respectively; or (g) a light chain variable region comprising (i) an amino acid sequence that has at least 75% sequence identity to SEQ ID NO:107, and (ii) a CDR-L1, CDR-L2, and CDR-L3 that is identical to SEQ ID NOs:135, 148, and 164, respectively; or (h) a light chain variable region comprising (i) an amino acid sequence that has at least 75% sequence identity to SEQ ID NO:108, and (ii) a CDR-L1, CDR-L2, and CDR-L3 that is identical to SEQ ID NOs:136, 150, and 165, respectively; or (i) a light chain variable region comprising (i) an amino acid sequence that has at least 75% sequence identity to SEQ ID NO:109, and (ii) a CDR-L1, CDR-L2, and CDR-L3 that is identical to SEQ ID NOs:137, 151, and 159, respectively; or (j) a light chain variable region comprising (i) an amino acid sequence that has at least 75% sequence identity to SEQ ID NO:110, and (ii) a CDR-L1, CDR-L2, and CDR-L3 that is identical to SEQ ID NOs:133, 147, and 166, respectively; or (k) a light chain variable region comprising (i) an amino acid sequence that has at least 75% sequence identity to SEQ ID NO:111, and (ii) a CDR-L1, CDR-L2, and CDR-L3 that is identical to SEQ ID NOs:138, 150, and 167, respectively; or (l) a light chain variable region comprising (i) an amino acid sequence that has at least 75% sequence identity to SEQ ID NO:112, and (ii) a CDR-L1, CDR-L2, and CDR-L3 that is identical to SEQ ID NOs:138, 152, and 168, respectively; or (m) a light chain variable region comprising (i) an amino acid sequence that has at least 75% sequence identity to SEQ ID NO:113, and (ii) a CDR-L1, CDR-L2, and CDR-L3 that is identical to SEQ ID NOs:138, 153, and 169, respectively; or (n) a light chain variable region comprising (i) an amino acid sequence that has at least 75% sequence identity to SEQ ID NO:114, and (ii) a CDR-L1, CDR-L2, and CDR-L3 that is identical to SEQ ID NOs:138, 152, and 170, respectively; or (o) a light chain variable region comprising (i) an amino acid sequence that has at least 75% sequence identity to SEQ ID NO:115, and (ii) a CDR-L1, CDR-L2, and CDR-L3 that is identical to SEQ ID NOs:139, 148, and 171, respectively; or (p) a light chain variable region comprising (i) an amino acid sequence that has at least 75% sequence identity to SEQ ID NO:116, and (ii) a CDR-L1, CDR-L2, and CDR-L3 that is identical to SEQ ID NOs:134, 149, and 172, respectively; or (q) a light chain variable region comprising (i) an amino acid sequence that has at least 75% sequence identity to SEQ ID NO:117, and (ii) a CDR-L1, CDR-L2, and CDR-L3 that is identical to SEQ ID NOs:140, 154, and 173, respectively; or (r) a light chain variable region comprising (i) an amino acid sequence that has at least 75% sequence identity to SEQ ID NO:118, and (ii) a CDR-L1, CDR-L2, and CDR-L3 that is identical to SEQ ID NOs:141, 155, and 174, respectively; or (s) a light chain variable region comprising (i) an amino acid sequence that has at least 75% sequence identity to SEQ ID NO:119, and (ii) a CDR-L1, CDR-L2, and CDR-L3 that is identical to SEQ ID NOs:142, 156, and 175, respectively; or (t) a light chain variable region comprising (i) an amino acid sequence that has at least 75% sequence identity to SEQ ID NO:120, and (ii) a CDR-L1, CDR-L2, and CDR-L3 that is identical to SEQ ID NOs:138, 152, and 168, respectively; or (u) a light chain variable region comprising (i) an amino acid sequence that has at least 75% sequence identity to SEQ ID NO:121, and (ii) a CDR-L1, CDR-L2, and CDR-L3 that is identical to SEQ ID NOs:138, 152, and 176, respectively; or (v) a light chain variable region comprising (i) an amino acid sequence that has at least 75% sequence identity to SEQ ID NO:114, and (ii) a CDR-L1, CDR-L2, and CDR-L3 that is identical to SEQ ID NOs:138, 152, and 170, respectively; or (w) a light chain variable region comprising (i) an amino acid sequence that has at least 75% sequence identity to SEQ ID NO:122, and (ii) a CDR-L1, CDR-L2, and CDR-L3 that is identical to SEQ ID NOs:143, 146, and 159, respectively; or (x) a light chain variable region comprising (i) an amino acid sequence that has at least 75% sequence identity to SEQ ID NO:123, and (ii) a CDR-L1, CDR-L2, and CDR-L3 that is identical to SEQ ID NOs:138, 146, and 177, respectively; or (y) a light chain variable region comprising (i) an amino acid sequence that has at least 75% sequence identity to SEQ ID NO:124, and (ii) a CDR-L1, CDR-L2, and CDR-L3 that is identical to SEQ ID NOs:138, 157, and 159, respectively; or (z) a light chain variable region comprising (i) an amino acid sequence that has at least 75% sequence identity to SEQ ID NO:125, and (ii) a CDR-L1, CDR-L2, and CDR-L3 that is identical to SEQ ID NOs:138, 152, and 159, respectively; or (aa) a light chain variable region comprising (i) an amino acid sequence that has at least 75% sequence identity to SEQ ID NO:126, and (ii) a CDR-L1, CDR-L2, and CDR-L3 that is identical to SEQ ID NOs:138, 146, and 159, respectively; or (ab) a light chain variable region comprising (i) an amino acid sequence that has at least 75% sequence identity to SEQ ID NO:127, and (ii) a CDR-L1, CDR-L2, and CDR-L3 that is identical to SEQ ID NOs:130, 146, and 159, respectively; or (ac) a light chain variable region comprising (i) an amino acid sequence that has at least 75% sequence identity to SEQ ID NO:128, and (ii) a CDR-L1, CDR-L2, and CDR-L3 that is identical to SEQ ID NOs:144, 146, and 159, respectively; or (ad) a light chain variable region comprising (i) an amino acid sequence that has at least 75% sequence identity to SEQ ID NO:316, and (ii) a CDR-L1, CDR-L2, and CDR-L3 that is identical to SEQ ID NOs:143, 146, and 159, respectively; or (ae) a light chain variable region comprising (i) an amino acid sequence that has at least 75% sequence identity to SEQ ID NO:317, and (ii) a CDR-L1, CDR-L2, and CDR-L3 that is identical to SEQ ID NOs:143, 146, and 159, respectively; or (af) a light chain variable region comprising (i) an amino acid sequence that has at least 75% sequence identity to SEQ ID NO:318, and (ii) a CDR-L1, CDR-L2, and CDR-L3 that is identical to SEQ ID NOs:143, 146, and 159, respectively; or (ag) a light chain variable region comprising (i) an amino acid sequence that has at least 75% sequence identity to SEQ ID NO:319, and (ii) a CDR-L1, CDR-L2, and CDR-L3 that is identical to SEQ ID NOs:143, 146, and 159, respectively; or (ah) a light chain variable region comprising (i) an amino acid sequence that has at least 75% sequence identity to SEQ ID NO:320, and (ii) a CDR-L1, CDR-L2, and CDR-L3 that is identical to SEQ ID NOs:143, 146, and 159, respectively; or (ai) a light chain variable region comprising (i) an amino acid sequence that has at least 75% sequence identity to SEQ ID NO:437, and (ii) a CDR-L1, CDR-L2, and CDR-L3 that is identical to SEQ ID NOs:143, 395, and 159, respectively; or (aj) a light chain variable region comprising (i) an amino acid sequence that has at least 75% sequence identity to SEQ ID NO:438, and (ii) a CDR-L1, CDR-L2, and CDR-L3 that is identical to SEQ ID NOs:143, 396, and 159, respectively; or (ak) a light chain variable region comprising (i) an amino acid sequence that has at least 75% sequence identity to SEQ ID NO:439, and (ii) a CDR-L1, CDR-L2, and CDR-L3 that is identical to SEQ ID NOs:143, 397, and 159, respectively; or (al) a light chain variable region comprising (i) an amino acid sequence that has at least 75% sequence identity to SEQ ID NO:440, and (ii) a CDR-L1, CDR-L2, and CDR-L3 that is identical to SEQ ID NOs:143, 398, and 159, respectively; or (am) a light chain variable region comprising (i) an amino acid sequence that has at least 75% sequence identity to SEQ ID NO:441, and (ii) a CDR-L1, CDR-L2, and CDR-L3 that is identical to SEQ ID NOs:143, 399, and 159, respectively; or (an) a light chain variable region comprising (i) an amino acid sequence that has at least 75% sequence identity to SEQ ID NO:442, and (ii) a CDR-L1, CDR-L2, and CDR-L3 that is identical to SEQ ID NOs:143, 400, and 159, respectively; or (ao) a light chain variable region comprising (i) an amino acid sequence that has at least 75% sequence identity to SEQ ID NO:443, and (ii) a CDR-L1, CDR-L2, and CDR-L3 that is identical to SEQ ID NOs:143, 146, and 167, respectively; or (ap) a light chain variable region comprising (i) an amino acid sequence that has at least 75% sequence identity to SEQ ID NO:444, and (ii) a CDR-L1, CDR-L2, and CDR-L3 that is identical to SEQ ID NOs:143, 146, and 403, respectively; or (aq) a light chain variable region comprising (i) an amino acid sequence that has at least 75% sequence identity to SEQ ID NO:445, and (ii) a CDR-L1, CDR-L2, and CDR-L3 that is identical to SEQ ID NOs:143, 146, and 404, respectively; or (ar) a light chain variable region comprising (i) an amino acid sequence that has at least 75% sequence identity to SEQ ID NO:446, and (ii) a CDR-L1, CDR-L2, and CDR-L3 that is identical to SEQ ID NOs:143, 146, and 405, respectively; or (as) a light chain variable region comprising (i) an amino acid sequence that has at least 75% sequence identity to SEQ ID NO:447, and (ii) a CDR-L1, CDR-L2, and CDR-L3 that is identical to SEQ ID NOs:143, 146, and 406, respectively; or (at) a light chain variable region comprising (i) an amino acid sequence that has at least 75% sequence identity to SEQ ID NO:463, and (ii) a CDR-L1, CDR-L2, and CDR-L3 that is identical to SEQ ID NOs:143, 395, and 405, respectively.

In some embodiments, the antibody or antigen-binding portion thereof comprises: (a) a heavy chain CDR1 comprising the amino acid sequence of SEQ ID NO:36; (b) a heavy chain CDR2 comprising the amino acid sequence of SEQ ID NO:61; and (c) a heavy chain CDR3 comprising the amino acid sequence of SEQ ID NO:88.

In some embodiments, the antibody or antigen-binding portion thereof comprises: (a) a light chain CDR1 comprising the amino acid sequence of SEQ ID NO:138; (b) a light chain CDR2 comprising the amino acid sequence of SEQ ID NO:150; and (c) a light chain CDR3 comprising the amino acid sequence of SEQ ID NO:167.

In some embodiments, the antibody or antigen-binding portion thereof comprises a heavy chain CDR1 comprising the amino acid sequence of SEQ ID NO:36, a heavy chain CDR2 comprising the amino acid sequence of SEQ ID NO:61, a heavy chain CDR3 comprising the amino acid sequence of SEQ ID NO:88, a light chain CDR1 comprising the amino acid sequence of SEQ ID NO:138, a light chain CDR2 comprising the amino acid sequence of SEQ ID NO:150, and a light chain CDR3 comprising the amino acid sequence of SEQ ID NO:167.

In some embodiments, the antibody or antigen-binding portion thereof comprises: (a) a heavy chain CDR1 comprising the amino acid sequence of SEQ ID NO:33; (b) a heavy chain CDR2 comprising the amino acid sequence of SEQ ID NO:55; and (c) a heavy chain CDR3 comprising the amino acid sequence of SEQ ID NO:82.

In some embodiments, the antibody or antigen-binding portion thereof comprises: (a) a light chain CDR1 comprising the amino acid sequence of SEQ ID NO:133; (b) a light chain CDR2 comprising the amino acid sequence of SEQ ID NO:147; and (c) a light chain CDR3 comprising the amino acid sequence of SEQ ID NO:162.

In some embodiments, the antibody or antigen-binding portion thereof comprises a heavy chain CDR1 comprising the amino acid sequence of SEQ ID NO:33, a heavy chain CDR2 comprising the amino acid sequence of SEQ ID NO:55, a heavy chain CDR3 comprising the amino acid sequence of SEQ ID NO:82, a light chain CDR1 comprising the amino acid sequence of SEQ ID NO:133, a light chain CDR2 comprising the amino acid sequence of SEQ ID NO:147, and a light chain CDR3 comprising the amino acid sequence of SEQ ID NO:162.

In some embodiments, the antibody or antigen-binding portion thereof comprises: (a) a heavy chain CDR1 comprising the amino acid sequence of SEQ ID NO:42; (b) a heavy chain CDR2 comprising the amino acid sequence of SEQ ID NO:65; and (c) a heavy chain CDR3 comprising the amino acid sequence of SEQ ID NO:92.

In some embodiments, the antibody or antigen-binding portion thereof comprises: (a) a light chain CDR1 comprising the amino acid sequence of SEQ ID NO:139; (b) a light chain CDR2 comprising the amino acid sequence of SEQ ID NO:148; and (c) a light chain CDR3 comprising the amino acid sequence of SEQ ID NO:171.

In some embodiments, the antibody or antigen-binding portion thereof comprises a heavy chain CDR1 comprising the amino acid sequence of SEQ ID NO:42, a heavy chain CDR2 comprising the amino acid sequence of SEQ ID NO:65, a heavy chain CDR3 comprising the amino acid sequence of SEQ ID NO:92, a light chain CDR1 comprising the amino acid sequence of SEQ ID NO:139, a light chain CDR2 comprising the amino acid sequence of SEQ ID NO:148, and a light chain CDR3 comprising the amino acid sequence of SEQ ID NO:171.

In some embodiments, the antibody or antigen-binding portion thereof comprises: (a) a heavy chain CDR1 comprising the amino acid sequence of SEQ ID NO:30; (b) a heavy chain CDR2 comprising the amino acid sequence of SEQ ID NO:52; and (c) a heavy chain CDR3 comprising the amino acid sequence of SEQ ID NO:79.

In some embodiments, the antibody or antigen-binding portion thereof comprises: (a) a light chain CDR1 comprising the amino acid sequence of SEQ ID NO:130; (b) a light chain CDR2 comprising the amino acid sequence of SEQ ID NO:146; and (c) a light chain CDR3 comprising the amino acid sequence of SEQ ID NO:159.

In some embodiments, the antibody or antigen-binding portion thereof comprises a heavy chain CDR1 comprising the amino acid sequence of SEQ ID NO:30, a heavy chain CDR2 comprising the amino acid sequence of SEQ ID NO:52, a heavy chain CDR3 comprising the amino acid sequence of SEQ ID NO:79, a light chain CDR1 comprising the amino acid sequence of SEQ ID NO:130, a light chain CDR2 comprising the amino acid sequence of SEQ ID NO:146, and a light chain CDR3 comprising the amino acid sequence of SEQ ID NO:159.

In some embodiments, the antibody or antigen-binding portion thereof comprises: (a) a heavy chain CDR1 comprising the amino acid sequence of SEQ ID NO:47; (b) a heavy chain CDR2 comprising the amino acid sequence of SEQ ID NO:72; and (c) a heavy chain CDR3 comprising the amino acid sequence of SEQ ID NO:99.

In some embodiments, the antibody or antigen-binding portion thereof comprises: (a) a light chain CDR1 comprising the amino acid sequence of SEQ ID NO:143; (b) a light chain CDR2 comprising the amino acid sequence of SEQ ID NO:146; and (c) a light chain CDR3 comprising the amino acid sequence of SEQ ID NO:159.

In some embodiments, the antibody or antigen-binding portion thereof comprises a heavy chain CDR1 comprising the amino acid sequence of SEQ ID NO:47, a heavy chain CDR2 comprising the amino acid sequence of SEQ ID NO:72, a heavy chain CDR3 comprising the amino acid sequence of SEQ ID NO:99, a light chain CDR1 comprising the amino acid sequence of SEQ ID NO:143, a light chain CDR2 comprising the amino acid sequence of SEQ ID NO:146, and a light chain CDR3 comprising the amino acid sequence of SEQ ID NO:159.

In some embodiments, the antibody or antigen-binding portion thereof comprises: (a) a heavy chain CDR1 comprising the amino acid sequence of SEQ ID NO:50; (b) a heavy chain CDR2 comprising the amino acid sequence of SEQ ID NO:77; and (c) a heavy chain CDR3 comprising the amino acid sequence of SEQ ID NO:100.

In some embodiments, the antibody or antigen-binding portion thereof comprises: (a) a light chain CDR1 comprising the amino acid sequence of SEQ ID NO:144; (b) a light chain CDR2 comprising the amino acid sequence of SEQ ID NO:146; and (c) a light chain CDR3 comprising the amino acid sequence of SEQ ID NO:159.

In some embodiments, the antibody or antigen-binding portion thereof comprises a heavy chain CDR1 comprising the amino acid sequence of SEQ ID NO:50, a heavy chain CDR2 comprising the amino acid sequence of SEQ ID NO:77, a heavy chain CDR3 comprising the amino acid sequence of SEQ ID NO:100, a light chain CDR1 comprising the amino acid sequence of SEQ ID NO:144, a light chain CDR2 comprising the amino acid sequence of SEQ ID NO:146, and a light chain CDR3 comprising the amino acid sequence of SEQ ID NO:159.

In some embodiments, the antibody or antigen-binding portion thereof comprises: (a) a heavy chain CDR1 comprising the amino acid sequence of SEQ ID NO:47; (b) a heavy chain CDR2 comprising the amino acid sequence of SEQ ID NO:416; and (c) a heavy chain CDR3 comprising the amino acid sequence of SEQ ID NO:425.

In some embodiments, the antibody or antigen-binding portion thereof comprises: (a) a heavy chain CDR1 comprising the amino acid sequence of SEQ ID NO:47; (b) a heavy chain CDR2 comprising the amino acid sequence of SEQ ID NO:420; and (c) a heavy chain CDR3 comprising the amino acid sequence of SEQ ID NO:425.

In some embodiments, the antibody or antigen-binding portion thereof comprises: (a) a light chain CDR1 comprising the amino acid sequence of SEQ ID NO:143; (b) a light chain CDR2 comprising the amino acid sequence of SEQ ID NO:395; and (c) a light chain CDR3 comprising the amino acid sequence of SEQ ID NO:405.

In some embodiments, the antibody or antigen-binding portion thereof comprises a heavy chain CDR1 comprising the amino acid sequence of SEQ ID NO:47, a heavy chain CDR2 comprising the amino acid sequence of SEQ ID NO:416, a heavy chain CDR3 comprising the amino acid sequence of SEQ ID NO:425, a light chain CDR1 comprising the amino acid sequence of SEQ ID NO:143, a light chain CDR2 comprising the amino acid sequence of SEQ ID NO:395, and a light chain CDR3 comprising the amino acid sequence of SEQ ID NO:405.

In some embodiments, the antibody or antigen-binding portion thereof comprises a heavy chain CDR1 comprising the amino acid sequence of SEQ ID NO:47, a heavy chain CDR2 comprising the amino acid sequence of SEQ ID NO:420, a heavy chain CDR3 comprising the amino acid sequence of SEQ ID NO:425, a light chain CDR1 comprising the amino acid sequence of SEQ ID NO:143, a light chain CDR2 comprising the amino acid sequence of SEQ ID NO:395, and a light chain CDR3 comprising the amino acid sequence of SEQ ID NO:405.

In some embodiments, the antibody or antigen-binding portion thereof comprises: (a) a heavy chain CDR1 comprising the amino acid sequence of SEQ ID NO:37; (b) a heavy chain CDR2 comprising the amino acid sequence of SEQ ID NO:59; and (c) a heavy chain CDR3 comprising the amino acid sequence of SEQ ID NO:86.

In some embodiments, the antibody or antigen-binding portion thereof comprises: (a) a light chain CDR1 comprising the amino acid sequence of SEQ ID NO:137; (b) a light chain CDR2 comprising the amino acid sequence of SEQ ID NO:151; and (c) a light chain CDR3 comprising the amino acid sequence of SEQ ID NO:159.

In some embodiments, the antibody or antigen-binding portion thereof comprises a heavy chain CDR1 comprising the amino acid sequence of SEQ ID NO:37, a heavy chain CDR2 comprising the amino acid sequence of SEQ ID NO:59, a heavy chain CDR3 comprising the amino acid sequence of SEQ ID NO:86, a light chain CDR1 comprising the amino acid sequence of SEQ ID NO:137, a light chain CDR2 comprising the amino acid sequence of SEQ ID NO:151, and a light chain CDR3 comprising the amino acid sequence of SEQ ID NO:159.

In some embodiments, the antibody or antigen-binding portion thereof comprises: (a) a heavy chain CDR1 comprising the amino acid sequence of SEQ ID NO:38; (b) a heavy chain CDR2 comprising the amino acid sequence of SEQ ID NO:60; and (c) a heavy chain CDR3 comprising the amino acid sequence of SEQ ID NO:87.

In some embodiments, the antibody or antigen-binding portion thereof comprises: (a) a light chain CDR1 comprising the amino acid sequence of SEQ ID NO:133; (b) a light chain CDR2 comprising the amino acid sequence of SEQ ID NO:147; and (c) a light chain CDR3 comprising the amino acid sequence of SEQ ID NO:166.

In some embodiments, the antibody or antigen-binding portion thereof comprises a heavy chain CDR1 comprising the amino acid sequence of SEQ ID NO:38, a heavy chain CDR2 comprising the amino acid sequence of SEQ ID NO:60, a heavy chain CDR3 comprising the amino acid sequence of SEQ ID NO:87, a light chain CDR1 comprising the amino acid sequence of SEQ ID NO:133, a light chain CDR2 comprising the amino acid sequence of SEQ ID NO:147, and a light chain CDR3 comprising the amino acid sequence of SEQ ID NO:166.

In some embodiments, the antibody or antigen-binding portion thereof comprises: (a) a heavy chain CDR1 comprising the amino acid sequence of SEQ ID NO:36; (b) a heavy chain CDR2 comprising the amino acid sequence of SEQ ID NO:58; and (c) a heavy chain CDR3 comprising the amino acid sequence of SEQ ID NO:85.

In some embodiments, the antibody or antigen-binding portion thereof comprises: (a) a light chain CDR1 comprising the amino acid sequence of SEQ ID NO:136; (b) a light chain CDR2 comprising the amino acid sequence of SEQ ID NO:150; and (c) a light chain CDR3 comprising the amino acid sequence of SEQ ID NO:165.

In some embodiments, the antibody or antigen-binding portion thereof comprises a heavy chain CDR1 comprising the amino acid sequence of SEQ ID NO:36, a heavy chain CDR2 comprising the amino acid sequence of SEQ ID NO:58, a heavy chain CDR3 comprising the amino acid sequence of SEQ ID NO:85, a light chain CDR1 comprising the amino acid sequence of SEQ ID NO:136, a light chain CDR2 comprising the amino acid sequence of SEQ ID NO:150, and a light chain CDR3 comprising the amino acid sequence of SEQ ID NO:165.

In some embodiments, the antibody or antigen-binding portion thereof comprises a heavy chain variable region comprising an amino acid sequence that has at least 90% sequence identity to SEQ ID NO:11 and a light chain variable region comprising an amino acid sequence that has at least 90% sequence identity to SEQ ID NO:111. In some embodiments, the antibody or antigen-binding portion thereof comprises a heavy chain variable region comprising an amino acid sequence that has at least 90% sequence identity to SEQ ID NO:5 and a light chain variable region comprising an amino acid sequence that has at least 90% sequence identity to SEQ ID NO:105. In some embodiments, the antibody or antigen-binding portion thereof comprises a heavy chain variable region comprising an amino acid sequence that has at least 90% sequence identity to SEQ ID NO:15 and a light chain variable region comprising an amino acid sequence that has at least 90% sequence identity to SEQ ID NO:115. In some embodiments, the antibody or antigen-binding portion thereof comprises a heavy chain variable region comprising an amino acid sequence that has at least 90% sequence identity to SEQ ID NO:2 and a light chain variable region comprising an amino acid sequence that has at least 90% sequence identity to SEQ ID NO:102. In some embodiments, the antibody or antigen-binding portion thereof comprises a heavy chain variable region comprising an amino acid sequence that has at least 90% sequence identity to SEQ ID NO:23 and a light chain variable region comprising an amino acid sequence that has at least 90% sequence identity to SEQ ID NO:122. In some embodiments, the antibody or antigen-binding portion thereof comprises a heavy chain variable region comprising an amino acid sequence that has at least 90% sequence identity to SEQ ID NO:28 and a light chain variable region comprising an amino acid sequence that has at least 90% sequence identity to SEQ ID NO:128. In some embodiments, the antibody or antigen-binding portion thereof comprises a heavy chain variable region comprising an amino acid sequence that has at least 90% sequence identity to SEQ ID NO:464 and a light chain variable region comprising an amino acid sequence that has at least 90% sequence identity to SEQ ID NO:463. In some embodiments, the antibody or antigen-binding portion thereof comprises a heavy chain variable region comprising an amino acid sequence that has at least 90% sequence identity to SEQ ID NO:465 and a light chain variable region comprising an amino acid sequence that has at least 90% sequence identity to SEQ ID NO:463. In some embodiments, the antibody or antigen-binding portion thereof comprises a heavy chain variable region comprising an amino acid sequence that has at least 90% sequence identity to SEQ ID NO:9 and a light chain variable region comprising an amino acid sequence that has at least 90% sequence identity to SEQ ID NO:109. In some embodiments, the antibody or antigen-binding portion thereof comprises a heavy chain variable region comprising an amino acid sequence that has at least 90% sequence identity to SEQ ID NO:10 and a light chain variable region comprising an amino acid sequence that has at least 90% sequence identity to SEQ ID NO:110. In some embodiments, the antibody or antigen-binding portion thereof comprises a heavy chain variable region comprising an amino acid sequence that has at least 90% sequence identity to SEQ ID NO:8 and a light chain variable region comprising an amino acid sequence that has at least 90% sequence identity to SEQ ID NO:108.

In some embodiments, the antibody comprises a first Fc polypeptide and optionally a second Fc polypeptide. In some embodiments, the antibody comprises the first Fc polypeptide and the second Fc polypeptide. In some embodiments, the first Fc polypeptide is a modified Fc polypeptide and/or the second Fc polypeptide is a modified Fc polypeptide.

In some embodiments, the antibody comprises: (a) a first antigen-binding portion comprising a first variable region that specifically binds to the human BACE1 protein, wherein the first antigen-binding portion comprises (i) a first heavy chain comprising a first Fc polypeptide and (ii) a first light chain; and (b) a second antigen-binding portion comprising a second variable region that specifically binds to the human BACE1 protein, wherein the second antigen-binding portion comprises (i) a second heavy chain comprising a second Fc polypeptide and (ii) a second light chain; wherein the first Fc polypeptide and the second Fc polypeptide form an Fc dimer. In some embodiments, the first Fc polypeptide is a modified Fc polypeptide and/or the second Fc polypeptide is a modified Fc polypeptide.

In some embodiments, the first variable region and the second variable region recognize the same epitope in the human BACE1 protein. In some embodiments, the first variable region and the second variable region recognize different epitopes in the human BACE1 protein. In some embodiments, the first Fc polypeptide and the second Fc polypeptide each contain modifications that promote heterodimerization. In some embodiments, one of the Fc polypeptides has a T366W substitution and the other Fc polypeptide has T366S, L368A, and Y407V substitutions, according to EU numbering.

In some embodiments, the first Fc polypeptide and/or the second Fc polypeptide comprises a native FcRn binding site. In some embodiments, the first Fc polypeptide and/or the second Fc polypeptide comprises a modification that alters FcRn binding. In some embodiments, the first Fc polypeptide and the second Fc polypeptide do not have effector function. In some embodiments, the first Fc polypeptide and/or the second Fc polypeptide includes a modification that reduces effector function. In some embodiments, the modification that reduces effector function comprises the substitutions of Ala at position 234 and Ala at position 235, according to EU numbering.

In some embodiments, the first Fc polypeptide and/or the second Fc polypeptide comprises amino acid changes relative to the native Fc sequence that extend serum stability or serum half-life. In some embodiments, the amino acid changes comprise substitutions of Tyr at position 252, Thr at position 254, and Glu at position 256, according to EU numbering. Alternatively, in some embodiments, the amino acid changes comprise substitutions of Leu at position 428 and Ser at position 434, according to EU numbering. Alternatively, in further embodiments, the amino acid changes comprise a substitution of Ser or Ala at position 434, according to EU numbering.

In some embodiments, the first Fc polypeptide and/or the second Fc polypeptide specifically binds to a transferrin receptor. In some embodiments, the first Fc polypeptide and/or the second Fc polypeptide comprises at least two substitutions at positions selected from the group consisting of 384, 386, 387, 388, 389, 390, 413, 416, and 421, according to EU numbering. In some embodiments, the first Fc polypeptide and/or the second Fc polypeptide comprises substitutions at least three, four, five, six, seven, eight, or nine of the positions. In some embodiments, the first Fc polypeptide and/or the second Fc polypeptide further comprises one, two, three, or four substitutions at positions comprising 380, 391, 392, and 415, according to EU numbering. In some embodiments, the first Fc polypeptide and/or the second Fc polypeptide further comprises one, two, or three substitutions at positions comprising 414, 424, and 426, according to EU numbering. In some embodiments, the first Fc polypeptide and/or the second Fc polypeptide comprises Trp at position 388. In some embodiments, the first Fc polypeptide and/or the second Fc polypeptide comprises an aromatic amino acid at position 421. In some embodiments, the aromatic amino acid at position 421 is Trp or Phe.

In some embodiments, the first Fc polypeptide and/or the second Fc polypeptide comprises at least one position selected from the following: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe. In some embodiments, the first Fc polypeptide and/or the second Fc polypeptide comprises 2, 3, 4, 5, 6, 7, 8, 9, 10, or 11 positions selected from the following: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe. In some embodiments, the first Fc polypeptide and/or the second Fc polypeptide comprises 11 positions as follows: position 380 is Trp, Leu, or Glu; position 384 is Tyr or Phe; position 386 is Thr; position 387 is Glu; position 388 is Trp; position 389 is Ser, Ala, Val, or Asn; position 390 is Ser or Asn; position 413 is Thr or Ser; position 415 is Glu or Ser; position 416 is Glu; and position 421 is Phe.

In some embodiments, the first Fc polypeptide and/or the second Fc polypeptide has a CH3 domain with at least 85% identity, at least 90% identity, or at least 95% identity to amino acids 111-217 of any one of SEQ ID NOs:183-219, 321-392, and 471-477. In some embodiments, the first Fc polypeptide and/or the second Fc polypeptide comprises the amino acid sequence of any one of SEQ ID NOs:183-219, 321-392, and 471-477. In some embodiments, the residues at least 5, 6, 7, 8, 9, 10, 11, 12, 13, 14, 15, or 16 of the positions corresponding to EU index positions 380, 384, 386, 387, 388, 389, 390, 391, 392, 413, 414, 415, 416, 421, 424 and 426 of any one of SEQ ID NOs:183-219, 321-392, and 471-477 are not deleted or substituted.

In some embodiments, the first Fc polypeptide and/or the second Fc polypeptide binds to the apical domain of the transferrin receptor. In some embodiments, the binding of the antibody or antigen-binding portion thereof to the transferrin receptor does not substantially inhibit binding of transferrin to the transferrin receptor. In some embodiments, the first Fc polypeptide and/or the second Fc polypeptide has an amino acid sequence identity of at least 75%, or at least 80%, 85%, 90%, 92%, or 95%, as compared to the corresponding wild-type Fc polypeptide. In some embodiments, the corresponding wild-type Fc polypeptide is a human IgG1, IgG2, IgG3, or IgG4 Fc polypeptide.

In some embodiments, uptake of the antibody or antigen-binding portion thereof into the brain is greater than the uptake of the antibody or antigen-binding portion thereof without the modifications in the first Fc polypeptide and/or the second Fc polypeptide that result in transferrin receptor binding. In some embodiments, uptake of the antibody or antigen-binding portion thereof into the brain is at least 2, 3, 4, 5, 6, 7, 8, 9, 10, 15, 20, 25, 30, 35, 40, 45, 50, 55, 60, 65, 70, 75, 80, 85, 90, 95, or 100-fold greater as compared to the uptake of the antibody or antigen-binding portion thereof without the modifications in the first Fc polypeptide and/or the second Fc polypeptide that result in transferrin receptor binding.

In other embodiments, one of the Fc polypeptides of the antibody is not modified to bind to a blood-brain barrier receptor and the other Fc polypeptide of the antibody is modified to specifically bind to a transferrin receptor.

In some embodiments, the antibody or antigen-binding portion thereof specifically binds to the human BACE1 protein with a binding affinity of less than about 75 nM. In some embodiments, the antibody or antigen-binding portion thereof specifically binds to the human BACE1 protein with a binding affinity of about 50 pM to about 75 nM. In some embodiments, the antibody or antigen-binding portion thereof specifically binds to the human BACE1 protein with a binding affinity of less than about 50 nM. In some embodiments, the antibody or antigen-binding portion thereof specifically binds to the human BACE1 protein with a binding affinity of about 50 pM to about 50 nM. In some embodiments, the antibody or antigen-binding portion thereof specifically binds to the human BACE1 protein with a binding affinity of less than about 20 nM. In some embodiments, the antibody or antigen-binding portion thereof specifically binds to the human BACE1 protein with a binding affinity of about 50 pM to about 20 nM. In some embodiments, the antibody or antigen-binding portion thereof specifically binds to the human BACE1 protein with a binding affinity of less than about 10 nM. In some embodiments, the antibody or antigen-binding portion thereof specifically binds to the human BACE1 protein with a binding affinity of about 50 pM to about 10 nM. In some embodiments, the antibody or antigen-binding portion thereof specifically binds to the human BACE1 protein with a binding affinity of less than about 5 nM. In some embodiments, the antibody or antigen-binding portion thereof specifically binds to the human BACE1 protein with a binding affinity of about 50 pM to about 5 nM.

In some embodiments, the antibody is a monoclonal antibody. In some embodiments, the antibody is a chimeric antibody. In some embodiments, the antibody is a humanized antibody. In some embodiments, the antibody is a fully human antibody. In some embodiments, the antigen-binding portion is a Fab, a F(ab')$_2$, an scFv, or a bivalent scFv.

In some embodiments, the antibody is a multispecific antibody. In some embodiments, the multispecific antibody is a bispecific antibody. In some embodiments, the bispecific antibody recognizes two different BACE1 epitopes.

In another aspect, antigen-binding fragments that specifically bind to a human BACE1 protein are provided. In some embodiments, the antigen-binding fragment further comprises an Fc polypeptide. In some embodiments, the Fc polypeptide is a modified Fc polypeptide. In some embodiments, the Fc polypeptide contains one or more of the modifications described herein, e.g., to promote heterodimerization, reduce effector function, extend serum stability or serum half-life, and/or bind to a transferrin receptor. As a non-limiting example, the antigen-binding fragment may include a Fab fragment that further comprises an Fc polypeptide, e.g., a Fab-Fc fusion. In other embodiments, the antigen-binding fragment further comprises a first Fc polypeptide and a second Fc polypeptide. In some embodiments, the first Fc polypeptide is a modified Fc polypeptide and/or the second Fc polypeptide is a modified Fc polypeptide. In some embodiments, the first Fc polypeptide and/or the second Fc polypeptide contains one or more of the modifications described herein, e.g., to promote heterodimerization, reduce effector function, extend serum stability or serum half-life, and/or bind to a transferrin receptor. As a non-limiting example, the antigen-binding fragment may include a F(ab')$_2$ fragment that further comprises a first Fc polypeptide and a second Fc polypeptide, e.g., F(ab')$_2$-Fc fusion.

In some embodiments, an antibody comprises a first Fc polypeptide having the sequence of any one of SEQ ID NOs:597-599 and 607-610 and/or a second Fc polypeptide having the sequence of any one of SEQ ID NOs:600-606. In some embodiments, an antibody comprises a first Fc polypeptide having the sequence of any one of SEQ ID NOs: 600-606 and/or a second Fc polypeptide having the sequence of any one of SEQ ID NOs: 597-599 and 607-610.

In yet another aspect, isolated humanized antibodies (or antigen-binding portions thereof) that specifically bind to a human BACE1 protein are provided. In some embodiments, the antibody or antigen-binding portion comprises: (a) a heavy chain variable region comprising an amino acid sequence that has at least 90% sequence identity to any one of SEQ ID NOs:310-315, 448-462, and 464-465; and/or (b) a light chain variable region comprising an amino acid sequence that has at least 90% sequence identity to any one of SEQ ID NOs:316-320, 437-447, and 463.

In some embodiments, the antibody or antigen-binding portion comprises: (a) a heavy chain variable region comprising an amino acid sequence that has at least 90% sequence identity to any one of SEQ ID NOs:310-315, 448-462, and 464-465; and (b) a light chain variable region comprising an amino acid sequence that has at least 90% sequence identity to any one of SEQ ID NOs:316-320, 437-447, and 463.

In some embodiments, the humanized antibody or an antigen-binding portion thereof recognizes a conformational epitope. In some embodiments, the humanized antibody or an antigen-binding portion thereof inhibits BACE1 activity. In some embodiments, the humanized antibody or an antigen-binding portion thereof reduces or inhibits the production and/or aggregation of amyloid-β peptides. In some embodiments, the humanized antibody or an antigen-binding portion thereof prevents, reduces, or inhibits the formation of amyloid plaques.

In another aspect, pharmaceutical compositions are provided. In some embodiments, the pharmaceutical composition comprises an isolated antibody or antigen-binding portion thereof of the present disclosure and a pharmaceutically acceptable carrier. In some embodiments, the pharmaceutical composition comprises a humanized antibody or antigen-binding portion thereof of the present disclosure and a pharmaceutically acceptable carrier.

In another aspect, isolated polynucleotides are provided. In some embodiments, the polynucleotide comprises a nucleotide sequence encoding an antibody or antigen-binding portion thereof of the present disclosure. In some embodiments, the polynucleotide comprises a nucleotide sequence encoding a humanized antibody or antigen-binding portion thereof of the present disclosure.

In yet another aspect, vectors are provided. In some embodiments, the vector comprises a polynucleotide of the present disclosure.

In still another aspect, host cells are provided. In some embodiments, the host cell comprises a polynucleotide of the present disclosure or a vector of the present disclosure.

In another aspect, antibodies that compete with an isolated antibody or humanized antibody of the present disclosure for binding to human BACE1 protein are provided.

In another aspect, methods for reducing or inhibiting production and/or aggregation of amyloid-β peptides in a brain of a subject are provided. In some embodiments, the method comprises administering to the subject an isolated antibody of the present disclosure, a bispecific antibody of the present disclosure, a humanized antibody of the present disclosure, or a pharmaceutical composition of the present disclosure. In some embodiments, the subject has a neurodegenerative disease.

In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

In another aspect, methods for preventing, reducing, or inhibiting the formation of amyloid plaques in a brain of a subject are provided. In some embodiments, the method comprises administering to the subject an isolated antibody of the present disclosure, a bispecific antibody of the present disclosure, a humanized antibody of the present disclosure, or a pharmaceutical composition of the present disclosure. In some embodiments, the subject has a neurodegenerative disease.

In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

In another aspect, methods for treating a neurodegenerative disease in a subject are provided. In some embodiments, the method comprises administering to the subject an isolated antibody of the present disclosure, a bispecific antibody of the present disclosure, a humanized antibody of the present disclosure, or a pharmaceutical composition of the present disclosure.

In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

BRIEF DESCRIPTION OF THE DRAWINGS

FIG. 4A shows data for 1D2. FIG. 4B shows data for 1D7. FIG. 4C shows data for 1F1. FIG. 4D shows data for 2H8.

FIG. 5A shows human Aβ40 levels that were measured from media of CHO cells stably overexpressing human APP treated with control IgG (i.e., an anti-RSV antibody), Clone35.23.4:2H8/2H8, or Clone35.23.4:Control IgG (anti-RSV)/2H8 antibody for 24 hours. Incubation with both the bivalent 2H8 (Clone35.23.4:2H8/2H8) as well as the monovalent 2H8 (Clone35.23.4:Control IgG (anti-RSV)/2H8) comprising a TfR-binding Fc polypeptide reduced human Aβ40 in a dose-dependent manner, whereas control IgG (anti-RSV) treatment had no effect. Line graphs represent mean±SEM, n=2 independent experiments. FIG. 5B shows cellular IC50 and maximum percent Aβ reduction compared to untreated controls from the experiment shown in FIG. 5A.

FIGS. 6A and 6B show plasma (FIG. 6A) and brain (FIG. 6B) huIgG1 concentrations in PS19/TfR$^{ms/hu}$ KI mice at various time points following a single 50 mg/kg intravenous injection of control IgG (i.e., an anti-RSV antibody), Clone35.23.4:2H8/2H8, or Clone35.23.4:Control IgG (anti-RSV)/2H8 antibody. Graphs represent mean±SEM, n=5 mice per group. Missing points for antibodies at later time points in FIGS. 6A and 6B are due to being below the lower limit of quantification. FIGS. 6C and 6D show brain (FIG. 6C) and CSF (FIG. 6D) Aβ40 concentrations in PS19/TfR$^{ms/hu}$ KI mice at various time points following a single 50 mg/kg intravenous injection of control IgG (anti-RSV), Clone35.23.4:2H8/2H8, or Clone35.23.4:Control IgG (anti-RSV)/2H8 antibody. Graphs represent mean±SEM, n=5 mice per group.

DETAILED DESCRIPTION

I. Introduction

Figure 1:
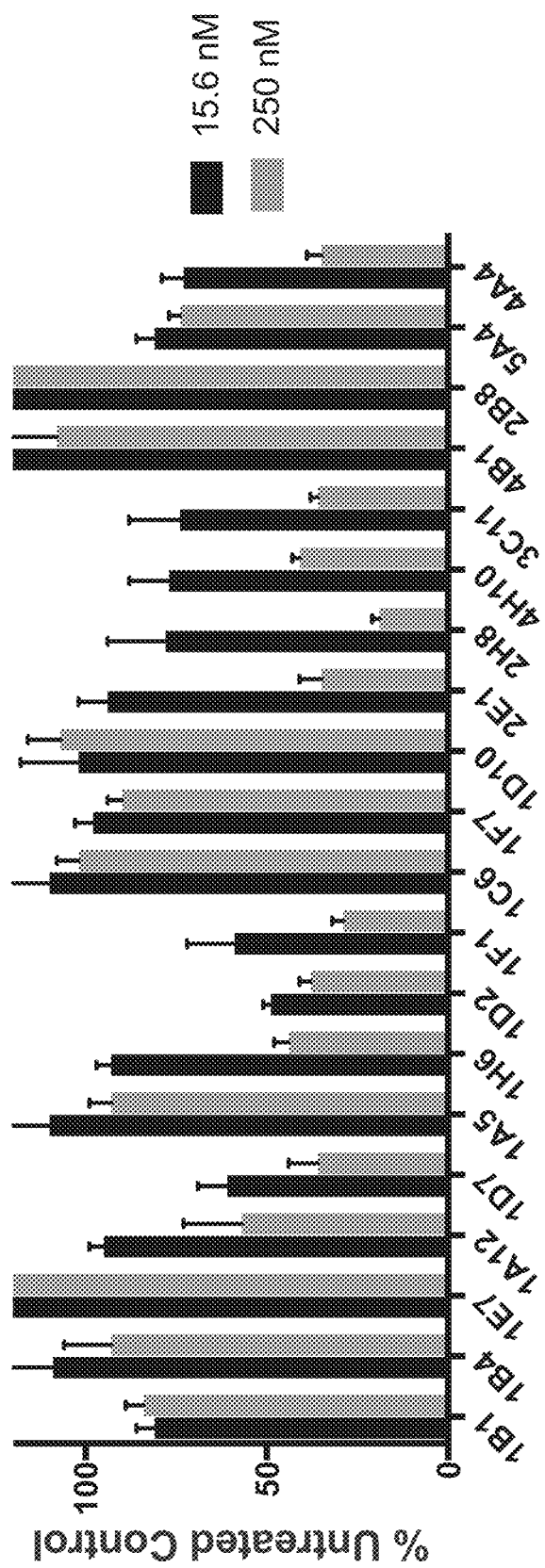
FIG. 1 shows the results of cellular APP cleavage assays using anti-BACE1 antibodies at 15.6 nM or 250 nM concentrations. The y-axis shows the relative amount of Aβ detected relative to untreated control cells.

The present disclosure relates to the discovery of antibodies that have the ability to specifically bind to beta-secretase 1 (BACE1) protein (e.g., human BACE1 protein). In some embodiments, the anti-BACE1 antibody specifically binds to one or more splice isoforms of BACE1 protein. In some embodiments, the anti-BACE1 antibody recognizes an epitope that is the same or substantially the same as the epitope recognized by antibody clone 3G10, 2E1, 1B4, 1A12, 1D7, 1A5, 1H6, 4H10, 3C11, 4A4, 1D2, 2G7, 5A4, 1B1, 1F1, 106, 1F7, 1D10, 4B1, 1F8, 2B8, 1E7, or 2H8.

In some embodiments, the anti-BACE1 antibody recognizes more than one epitope of BACE1 protein. In some embodiments, the anti-BACE1 antibody is fused to a modified Fc polypeptide that specifically binds a transferrin receptor. In some embodiments, the anti-BACE1 antibody comprises one or more modifications that promote heterodimerization, reduce effector function, and/or increase serum stability or serum-half-life. In some embodiments, the anti-BACE1 antibody comprises a native FcRn binding site.

The anti-BACE1 antibodies described herein are useful for, as non-limiting examples, reducing or inhibiting production and/or aggregation of amyloid-β peptides in a brain of a subject and/or preventing, reducing, or inhibiting the formation of amyloid plaques in a brain of a subject. Accordingly, the anti-BACE1 antibodies of the present disclosure are useful for preventing or treating any number of neurodegenerative diseases including, but not limited to, Alzheimer's disease.

II. DEFINITIONS

As used herein, the singular forms "a," "an," and "the" include plural referents unless the content clearly dictates otherwise. Thus, for example, reference to "an antibody" may include two or more such molecules, and the like.

As used herein, the terms "about" and "approximately," when used to modify an amount specified in a numeric value or range, indicate that the numeric value as well as reasonable deviations from the value known to the skilled person in the art, for example ±20%, ±10%, or ±5%, are within the intended meaning of the recited value.

As used herein, the term "BACE1 protein" refers to beta-secretase 1 (EC 3.4.23.46), which is an enzyme involved in proteolytic processing of the amyloid precursor protein. The term "BACE1" as used herein refers to a BACE1 protein of any vertebrate, such as but not limited to human, non-human primates (e.g., cynomolgus monkey), rodents (e.g., mice), and other mammals. The sequence of human BACE1 is available under UniProt entry P56817. It will be recognized by a person of ordinary skill in the art that in humans, there are six isoforms of BACE1 that result from alternative splicing of the gene encoding BACE1: Isoform A (BACE-1A), having a length of 501 amino acids; Isoform B (BACE-1B), having a length of 476 amino acids; Isoform C (BACE-1C), having a length of 457 amino acids; Isoform D (BACE-1D) having a length of 432 amino acids; Isoform 5, having a length of 401 amino acids; and Isoform 6, having a length of 376 amino acids. The amino acid sequence of "full-length" BACE1 (Isoform A) is provided as SEQ ID NO:305. Non-human BACE1 sequences have also been described, including mouse (UniProt entry P56818) and chimpanzee (UniProt entry K7CPE6). As used herein, the term "BACE1 protein" encompasses a full-length BACE1 protein having a length of 501 amino acids (SEQ ID NO:305) and other isoforms of BACE1, as well as proprotein forms of BACE1 proteins (e.g., SEQ ID NO:306) and mature forms of BACE1 proteins (e.g., SEQ ID NO:307).

As used herein, the term "anti-BACE1 antibody" refers to an antibody that specifically binds to a BACE1 protein (e.g., human BACE1). In some embodiments, an anti-BACE1 antibody is an antibody that specifically binds to multiple forms of BACE1 protein (e.g., multiple BACE1 splice isoforms). In some embodiments, an anti-BACE1 antibody is an antibody that specifically binds to a mature form of BACE1 that lacks a signal peptide sequence and that has been proteolytically processed from a proprotein (e.g., SEQ ID NO:307) and/or that specifically binds to a proprotein form of BACE1 (e.g., SEQ ID NO:306).

As used herein, the term "antibody" refers to a protein with an immunoglobulin fold that specifically binds to an antigen via its variable regions. The term encompasses intact polyclonal antibodies, intact monoclonal antibodies, single chain antibodies, multispecific antibodies such as bispecific antibodies, monospecific antibodies, monovalent antibodies, chimeric antibodies, humanized antibodies, and human antibodies. The term "antibody," as used herein, also includes antibody fragments that retain antigen-binding specificity via its variable region, including but not limited to Fab, F(ab')$_2$, Fv, scFv, and bivalent scFv. Antibodies can contain light chains that are classified as either kappa or lambda. Antibodies can contain heavy chains that are classified as gamma, mu, alpha, delta, or epsilon, which in turn define the immunoglobulin classes, IgG, IgM, IgA, IgD and IgE, respectively.

An exemplary immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms "variable light chain" (VL) and "variable heavy chain" (VH) refer to these light and heavy chains, respectively.

The term "variable region" or "variable domain" refers to a domain in an antibody heavy chain or light chain that is derived from a germline Variable (V) gene, Diversity (D) gene, or Joining (J) gene (and not derived from a Constant (Cμ and Cδ) gene segment), and that gives an antibody its specificity for binding to an antigen. Typically, an antibody variable region comprises four conserved "framework" regions interspersed with three hypervariable "complementarity determining regions."

The term "complementarity determining region" or "CDR" refers to the three hypervariable regions in each chain that interrupt the four framework regions established by the light and heavy chain variable regions. The CDRs are primarily responsible for antibody binding to an epitope of an antigen. The CDRs of each chain are typically referred to as CDR1, CDR2, and CDR3, numbered sequentially starting from the N-terminus, and are also typically identified by the chain in which the particular CDR is located. Thus, a VH CDR3 or CDR-H3 is located in the variable region of the heavy chain of the antibody in which it is found, whereas a VL CDR1 or CDR-L1 is the CDR1 from the variable region of the light chain of the antibody in which it is found.

The "framework regions" or "FRs" of different light or heavy chains are relatively conserved within a species. The framework region of an antibody, that is the combined framework regions of the constituent light and heavy chains, serves to position and align the CDRs in three-dimensional space. Framework sequences can be obtained from public DNA databases or published references that include germline antibody gene sequences. For example, germline DNA sequences for human heavy and light chain variable region genes can be found in the "VBASE2" germline variable gene sequence database for human and mouse sequences.

The amino acid sequences of the CDRs and framework regions can be determined using various well known definitions in the art, e.g., Kabat, Chothia, international ImMunoGeneTics database (IMGT), AbM, and observed antigen contacts ("Contact"). In some embodiments, CDRs are determined according to the Contact definition. See, MacCallum et al., J. Mol. Biol., 262:732-745 (1996). In some embodiments, CDRs are determined by a combination of Kabat, Chothia, and Contact CDR definitions.

The terms "antigen-binding portion" and "antigen-binding fragment" are used interchangeably herein and refer to one or more fragments of an antibody that retains the ability to specifically bind to an antigen (e.g., a BACE1 protein) via its variable region. Examples of antigen-binding fragments include, but are not limited to, a Fab fragment (a monovalent fragment consisting of the VL, VH, CL, and CH1 domains), a F(ab')$_2$ fragment (a bivalent fragment comprising two Fab fragments linked by a disulfide bridge at the hinge region), a single chain Fv (scFv), a disulfide-linked Fv (dsFv), complementarity determining regions (CDRs), a VL (light chain variable region), and a VH (heavy chain variable region).

The term "epitope" refers to the area or region of an antigen to which the CDRs of an antibody specifically bind, and can include a few amino acids or portions of a few amino acids, e.g., 5 or 6, or more, e.g., 20 or more amino acids, or portions of those amino acids. For example, where the target is a protein, the epitope can be comprised of consecutive amino acids (e.g., a linear epitope), or amino acids from different parts of the protein that are brought into proximity by protein folding (e.g., a discontinuous or conformational epitope). In some embodiments, an antibody specifically binds to two distinct regions of an antigen (e.g., a BACE1 protein) that are not brought into proximity by protein folding, referred to herein as a "dual epitope." In some embodiments, the epitope is phosphorylated at one amino acid (e.g., at a serine or threonine residue).

As used herein, the phrase "recognizes an epitope," as used with reference to an anti-BACE1 antibody, means that the antibody CDRs interact with or specifically bind to the antigen (i.e., the BACE1 protein) at that epitope or a portion of the antigen containing that epitope.

As used herein, the term "multispecific antibody" refers to an antibody that comprises two or more different antigen-binding portions, in which each antigen-binding portion comprises a different variable region that recognizes a different antigen, or a fragment or portion of the antibody that binds to the two or more different antigens via its variable regions. As used herein, the term "bispecific antibody" refers to an antibody that comprises two different antigen-binding portions, in which each antigen-binding portion comprises a different variable region that recognizes a different antigen, or a fragment or portion of the antibody that binds to the two different antigens via its variable regions. In some embodiments, a bispecific antibody comprises a first antigen-binding portion comprising a first variable region that recognizes a BACE1 protein and a second antigen-binding portion comprising a second variable region that recognizes a non-BACE1 antigen.

A "monoclonal antibody" refers to antibodies produced by a single clone of cells or a single cell line and consisting of or consisting essentially of antibody molecules that are identical in their primary amino acid sequence.

A "polyclonal antibody" refers to an antibody obtained from a heterogeneous population of antibodies in which different antibodies in the population bind to different epitopes of an antigen.

A "chimeric antibody" refers to an antibody molecule in which the constant region, or a portion thereof, is altered, replaced or exchanged so that the antigen binding site (i.e., variable region, CDR, or portion thereof) is linked to a constant region of a different or altered class, effector function and/or species, or in which the variable region, or a portion thereof, is altered, replaced or exchanged with a variable region having a different or altered antigen specificity (e.g., CDR and framework regions from different species). In some embodiments, a chimeric antibody is a monoclonal antibody comprising a variable region from one source or species (e.g., mouse) and a constant region derived from a second source or species (e.g., human). Methods for producing chimeric antibodies are described in the art.

"Humanized" antibodies are chimeric immunoglobulins derived from a non-human source (e.g., murine) that contain minimal sequences derived from the non-human immunoglobulin outside the CDRs. In general, a humanized antibody will comprise at least one (e.g., two) antigen-binding variable domain(s), in which the CDR regions substantially correspond to those of the non-human immunoglobulin and the framework regions substantially correspond to those of a human immunoglobulin sequence. In some instances, certain framework region residues of a human immunoglobulin can be replaced with the corresponding residues from a non-human species to, e.g., improve specificity, affinity, and/or serum stability or serum half-life. The humanized antibody can also comprise at least a portion of an immunoglobulin constant region (Fc), typically that of a human immunoglobulin sequence. Methods of antibody humanization are described in Example 1.

A "human antibody" or a "fully human antibody" is an antibody having human heavy chain and light chain sequences, typically derived from human germline genes. In some embodiments, the antibody is produced by a human cell, by a non-human animal that utilizes human antibody repertoires (e.g., transgenic mice that are genetically engineered to express human antibody sequences), or by phage display platforms.

The term "specifically binds" refers to a molecule (e.g., an antibody (or an antigen-binding portion thereof) or a modified Fc polypeptide (or a target-binding portion thereof)) that binds to an epitope or target with greater affinity, greater avidity, and/or greater duration to that epitope or target in a sample than it binds to another epitope or non-target compound (e.g., a structurally different antigen). In some embodiments, an antibody (or an antigen-binding portion thereof) or a modified Fc polypeptide (or a target-binding portion thereof) that specifically binds to an epitope or target is an antibody (or an antigen-binding portion thereof) or a modified Fc polypeptide (or a target-binding portion thereof) that binds to the epitope or target with at least 5-fold greater affinity than other epitopes or non-target compounds, e.g., at least 10-fold, 50-fold, 100-fold, 1,000-fold, 10,000-fold, or greater affinity. The term "specific binding," "specifically binds to," or "is specific for" a particular epitope or target, as used herein, can be exhibited, for example, by a molecule having an equilibrium dissociation constant $K_D$ for the epitope or target to which it binds of, e.g., $10^{-4}$ M or smaller, e.g., $10^{-5}$ M, $10^{-6}$ M, $10^{-7}$ M, $10^{-8}$ M, $10^{-9}$ M, $10^{-10}$ M, $10^{-11}$ M, or $10^{-12}$ M. It will be recognized by one of skill that an antibody that specifically binds to a target (e.g., a BACE1 protein) from one species may also specifically bind to orthologs of that target (e.g., a BACE1 protein).

The term "binding affinity" is used herein to refer to the strength of a non-covalent interaction between two molecules, e.g., between an antibody (or an antigen-binding portion thereof) and an antigen, or between a modified Fc polypeptide (or a target-binding portion thereof) and a target. Thus, for example, the term may refer to 1:1 interactions between an antibody (or an antigen-binding portion thereof) and an antigen or between a modified Fc polypeptide (or a target-binding portion thereof) and a target, unless otherwise indicated or clear from context. Binding affinity may be quantified by measuring an equilibrium dissociation constant ($K_D$), which refers to the dissociation rate constant ($k_d$, time$^{-1}$) divided by the association rate constant ($k_a$, time$^{-1}$ M$^{-1}$). $K_D$ can be determined by measurement of the kinetics of complex formation and dissociation, e.g., using Surface Plasmon Resonance (SPR) methods, e.g., a Biacore™ system; kinetic exclusion assays such as KinExA®; and BioLayer interferometry (e.g., using the ForteBio® Octet platform). As used herein, "binding affinity" includes not only formal binding affinities, such as those reflecting 1:1 interactions between an antibody (or an antigen-binding portion thereof) and an antigen or between a modified Fc polypeptide (or a target-binding portion thereof) and a target, but also apparent affinities for which $K_D$'s are calculated that may reflect avid binding.

A "transferrin receptor" or "TfR" as used in the context of this disclosure refers to transferrin receptor protein 1. The human transferrin receptor 1 polypeptide sequence is set forth in SEQ ID NO:303. Transferrin receptor protein 1 sequences from other species are also known (e.g., chimpanzee, accession number XP_003310238.1; rhesus monkey, NP_001244232.1; dog, NP_001003111.1; cattle, NP_001193506.1; mouse, NP_035768.1; rat, NP_073203.1; and chicken, NP_990587.1). The term "transferrin receptor" also encompasses allelic variants of exemplary reference sequences, e.g., human sequences, that are encoded by a gene at a transferrin receptor protein 1 chromosomal locus. Full-length transferrin receptor protein includes a short N-terminal intracellular region, a transmembrane region, and a large extracellular domain. The extracellular domain is characterized by three domains: a protease-like domain, a helical domain, and an apical domain.

As used herein, the term "Fc polypeptide" refers to the C-terminal region of a naturally occurring immunoglobulin heavy chain polypeptide that is characterized by an Ig fold as a structural domain. An Fc polypeptide contains constant region sequences including at least the CH2 domain and/or the CH3 domain and may contain at least part of the hinge region. In general, an Fc polypeptide does not contain a variable region.

A "modified Fc polypeptide" refers to an Fc polypeptide that has at least one mutation, e.g., a substitution, deletion or insertion, as compared to a wild-type immunoglobulin heavy chain Fc polypeptide sequence, but retains the overall Ig fold or structure of the native Fc polypeptide.

The term "FcRn" refers to the neonatal Fc receptor. Binding of Fc polypeptides to FcRn reduces clearance and increases serum stability or serum half-life of the Fc polypeptide. The human FcRn protein is a heterodimer that is composed of a protein of about 50 kDa in size that is similar to a major histocompatibility (MEW) class I protein and a β2-microglobulin of about 15 kDa in size.

As used herein, an "FcRn binding site" refers to the region of an Fc polypeptide that binds to FcRn. In human IgG, the FcRn binding site, as numbered using the EU index, includes T250, L251, M252, I253, S254, R255, T256, T307, E380, M428, H433, N434, H435, and Y436. These positions correspond to positions 20 to 26, 77, 150, 198, and 203 to 206 of SEQ ID NO:302.

As used herein, a "native FcRn binding site" refers to a region of an Fc polypeptide that binds to FcRn and that has the same amino acid sequence as the region of a naturally occurring Fc polypeptide that binds to FcRn.

The terms "CH3 domain" and "CH2 domain" as used herein refer to immunoglobulin constant region domain polypeptides. For purposes of this application, a CH3 domain polypeptide refers to the segment of amino acids from about position 341 to about position 447 as numbered according to the EU numbering scheme, and a CH2 domain polypeptide refers to the segment of amino acids from about position 231 to about position 340 as numbered according to the EU numbering scheme and does not include hinge region sequences. CH2 and CH3 domain polypeptides may also be numbered by the IMGT (ImMunoGeneTics) numbering scheme in which the CH2 domain numbering is 1-110 and the CH3 domain numbering is 1-107, according to the IMGT Scientific chart numbering (IMGT website). CH2 and CH3 domains are part of the Fc region of an immunoglobulin. An Fc region refers to the segment of amino acids from about position 231 to about position 447 as numbered according to the EU numbering scheme, but as used herein, can include at least a part of a hinge region of an antibody. An illustrative hinge region sequence is the human IgG1 hinge sequence EPKSCDKTHTCPPCP (SEQ ID NO:304).

The terms "wild-type," "native," and "naturally occurring" with respect to a CH3 or CH2 domain are used herein to refer to a domain that has a sequence that occurs in nature.

In the context of this disclosure, the term "mutant" with respect to a mutant polypeptide or mutant polynucleotide is used interchangeably with "variant." A variant with respect to a given wild-type CH3 or CH2 domain reference sequence can include naturally occurring allelic variants. A "non-naturally" occurring CH3 or CH2 domain refers to a variant or mutant domain that is not present in a cell in nature and that is produced by genetic modification, e.g., using genetic engineering technology or mutagenesis techniques, of a native CH3 domain or CH2 domain polynucleotide or polypeptide. A "variant" includes any domain comprising at least one amino acid mutation with respect to wild-type. Mutations may include substitutions, insertions, and deletions.

The term "cross-reacts," as used herein, refers to the ability of an antibody variable region to bind to an antigen other than the antigen against which the antibody was raised. In some embodiments, cross-reactivity refers to the ability of an antibody variable region to bind to an antigen from another species than the antigen against which the antibody was raised. As a non-limiting example, an anti-BACE1 antibody as described herein that is raised against a human BACE1 protein can exhibit cross-reactivity with a BACE1 protein from a different species (e.g., mouse or monkey).

The term "isolated," as used with reference to a nucleic acid or protein (e.g., antibody), denotes that the nucleic acid or protein is essentially free of other cellular components with which it is associated in the natural state. Purity and homogeneity are typically determined using analytical chemistry techniques such as electrophoresis (e.g., polyacrylamide gel electrophoresis) or chromatography (e.g., high performance liquid chromatography). In some embodiments, an isolated nucleic acid or protein (e.g., antibody) is at least 85% pure, at least 90% pure, at least 95% pure, or at least 99% pure.

The term "amino acid" refers to naturally occurring and synthetic amino acids, as well as "amino acid analogs" and amino acid mimetics that function in a manner similar to the naturally occurring amino acids.

Naturally occurring amino acids are those encoded by the genetic code, as well as those amino acids that are later modified, e.g., hydroxyproline, γ-carboxyglutamate and O-phosphoserine. Naturally occurring α-amino acids include, without limitation, alanine (Ala), cysteine (Cys), aspartic acid (Asp), glutamic acid (Glu), phenylalanine (Phe), glycine (Gly), histidine (His), isoleucine (Ile), arginine (Arg), lysine (Lys), leucine (Leu), methionine (Met), asparagine (Asn), proline (Pro), glutamine (Gln), serine (Ser), threonine (Thr), valine (Val), tryptophan (Trp), tyrosine (Tyr), and combinations thereof. Stereoisomers of a naturally occurring α-amino acids include, without limitation, D-alanine (D-Ala), D-cysteine (D-Cys), D-aspartic acid (D-Asp), D-glutamic acid (D-Glu), D-phenylalanine (D-Phe), D-histidine (D-His), D-isoleucine (D-Ile), D-arginine (D-Arg), D-lysine (D-Lys), D-leucine (D-Leu), D-methionine (D-Met), D-asparagine (D-Asn), D-proline (D-Pro), D-glutamine (D-Gln), D-serine (D-Ser), D-threonine (D-Thr), D-valine (D-Val), D-tryptophan (D-Trp), D-tyrosine (D-Tyr), and combinations thereof.

Amino acids may be referred to herein by either their commonly known three letter symbols or by the one-letter symbols recommended by the IUPAC-IUB Biochemical Nomenclature Commission.

The terms "polypeptide" and "peptide" are used interchangeably herein to refer to a polymer of amino acid residues in a single chain. The terms apply to amino acid polymers in which one or more amino acid residue is an artificial chemical mimetic of a corresponding naturally occurring amino acid, as well as to naturally occurring amino acid polymers and non-naturally occurring amino acid polymers. Amino acid polymers may comprise entirely L-amino acids, entirely D-amino acids, or a mixture of L and D amino acids.

The term "protein" as used herein refers to either a polypeptide or a dimer (i.e, two) or multimer (i.e., three or more) of single chain polypeptides. The single chain polypeptides of a protein may be joined by a covalent bond, e.g., a disulfide bond, or non-covalent interactions.

The terms "polynucleotide" and "nucleic acid" interchangeably refer to chains of nucleotides of any length, and include DNA and RNA. The nucleotides can be deoxyribonucleotides, ribonucleotides, modified nucleotides or bases, and/or their analogs, or any substrate that can be incorporated into a chain by a DNA or RNA polymerase. A polynucleotide may comprise modified nucleotides, such as methylated nucleotides and their analogs. Examples of polynucleotides contemplated herein include single- and double-stranded DNA, single- and double-stranded RNA, and hybrid molecules having mixtures of single- and double-stranded DNA and RNA.

The terms "conservative substitution" and "conservative mutation" refer to an alteration that results in the substitution of an amino acid with another amino acid that can be categorized as having a similar feature. Examples of categories of conservative amino acid groups defined in this manner can include: a "charged/polar group" including Glu (Glutamic acid or E), Asp (Aspartic acid or D), Asn (Asparagine or N), Gln (Glutamine or Q), Lys (Lysine or K), Arg (Arginine or R), and His (Histidine or H); an "aromatic group" including Phe (Phenylalanine or F), Tyr (Tyrosine or Y), Trp (Tryptophan or W), and (Histidine or H); and an "aliphatic group" including Gly (Glycine or G), Ala (Alanine or A), Val (Valine or V), Leu (Leucine or L), Ile (Isoleucine or I), Met (Methionine or M), Ser (Serine or S), Thr (Threonine or T), and Cys (Cysteine or C). Within each group, subgroups can also be identified. For example, the group of charged or polar amino acids can be sub-divided into sub-groups including: a "positively-charged sub-group" comprising Lys, Arg and His; a "negatively-charged sub-group" comprising Glu and Asp; and a "polar sub-group" comprising Asn and Gln. In another example, the aromatic or cyclic group can be sub-divided into sub-groups including: a "nitrogen ring sub-group" comprising Pro, His and Trp; and a "phenyl sub-group" comprising Phe and Tyr. In another further example, the aliphatic group can be sub-divided into sub-groups, e.g., an "aliphatic non-polar sub-group" comprising Val, Leu, Gly, and Ala; and an "aliphatic slightly-polar sub-group" comprising Met, Ser, Thr, and Cys. Examples of categories of conservative mutations include amino acid substitutions of amino acids within the sub-groups above, such as, but not limited to: Lys for Arg or vice versa, such that a positive charge can be maintained; Glu for Asp or vice versa, such that a negative charge can be maintained; Ser for Thr or vice versa, such that a free —OH can be maintained; and Gln for Asn or vice versa, such that a free —NH$_2$ can be maintained. In some embodiments, hydrophobic amino acids are substituted for naturally occurring hydrophobic amino acid, e.g., in the active site, to preserve hydrophobicity.

The terms "identical" or percent "identity," in the context of two or more polypeptide sequences, refer to two or more sequences or subsequences that are the same or have a specified percentage of amino acid residues, e.g., at least 60%, at least 65%, at least 70%, at least 75%, at least 80%, at least 85%, at least 90%, or at least 95% or greater, that are identical over a specified region when compared and aligned for maximum correspondence over a comparison window, or designated region, as measured using a sequence comparison algorithm or by manual alignment and visual inspection.

For sequence comparison of polypeptides, typically one amino acid sequence acts as a reference sequence, to which a candidate sequence is compared. Alignment can be performed using various methods available to one of skill in the art, e.g., visual alignment or using publicly available software using known algorithms to achieve maximal alignment. Such programs include the BLAST programs, ALIGN, ALIGN-2 (Genentech, South San Francisco, Calif.) or Megalign (DNASTAR). The parameters employed for an alignment to achieve maximal alignment can be determined by one of skill in the art. For sequence comparison of polypeptide sequences for purposes of this application, the BLASTP algorithm standard protein BLAST for aligning two proteins sequence with the default parameters is used.

The terms "corresponding to," "determined with reference to," or "numbered with reference to" when used in the context of the identification of a given amino acid residue in a polypeptide sequence, refers to the position of the residue of a specified reference sequence when the given amino acid sequence is maximally aligned and compared to the reference sequence. Thus, for example, an amino acid residue in a modified Fc polypeptide "corresponds to" an amino acid in SEQ ID NO:302, when the residue aligns with the amino acid in SEQ ID NO:302 when optimally aligned to SEQ ID NO:302. The polypeptide that is aligned to the reference sequence need not be the same length as the reference sequence.

The term "subject," "individual," and "patient," as used interchangeably herein, refer to a mammal, including but not limited to humans, non-human primates, rodents (e.g., rats, mice, and guinea pigs), rabbits, cows, pigs, horses, and other mammalian species. In one embodiment, the patient is a human.

The terms "treatment," "treating," and the like are used herein to generally mean obtaining a desired pharmacologic and/or physiologic effect. "Treating" or "treatment" may refer to any indicia of success in the treatment or amelioration of a neurodegenerative disease (e.g., Alzheimer's disease or another neurodegenerative disease described herein), including any objective or subjective parameter such as abatement, remission, improvement in patient survival, increase in survival time or rate, diminishing of symptoms or making the disease more tolerable to the patient, slowing in the rate of degeneration or decline, or improving a patient's physical or mental well-being. The treatment or amelioration of symptoms can be based on objective or subjective parameters. The effect of treatment can be compared to an individual or pool of individuals not receiving the treatment, or to the same patient prior to treatment or at a different time during treatment.

The term "pharmaceutically acceptable excipient" refers to a non-active pharmaceutical ingredient that is biologically or pharmacologically compatible for use in humans or animals, such as but not limited to a buffer, carrier, or preservative.

As used herein, a "therapeutic amount" or "therapeutically effective amount" of an agent (e.g., an antibody as described herein) is an amount of the agent that treats, alleviates, abates, or reduces the severity of symptoms of a disease in a subject. A "therapeutic amount" or "therapeutically effective amount" of an agent (e.g., an antibody as described herein) may improve patient survival, increase survival time or rate, diminish symptoms, make an injury, disease, or condition (e.g., a neurodegenerative disease) more tolerable, slow the rate of degeneration or decline, or improve a patient's physical or mental well-being.

The term "administer" refers to a method of delivering agents, compounds, or compositions to the desired site of biological action. These methods include, but are not limited to, topical delivery, parenteral delivery, intravenous delivery, intradermal delivery, intramuscular delivery, intrathecal delivery, colonic delivery, rectal delivery, or intraperitoneal delivery. In one embodiment, an antibody as described herein is administered intravenously.

III. ANTI-BACE1 ANTIBODIES

In one aspect, antibodies and antigen-binding portions of antibodies that specifically bind to a BACE1 protein (e.g., human BACE1 protein) are provided. In some embodiments, the anti-BACE1 antibody specifically binds to a mature full-length BACE1 protein comprising the amino acid sequence set forth in SEQ ID NO:306. In some embodiments, the antibody specifically binds to one or more splice isoforms of human BACE1 protein (i.e., one or more of the splice isoforms A, B, C, D, 5, and 6). In some embodiments, the antibody specifically binds to two or more splice isoforms of human BACE1 protein, e.g., to two, three, four, five, or all six of the splice isoforms A, B, C, D, 5, and 6.

In another aspect, antibodies and antigen-binding portions thereof that bind to a BACE1 protein (e.g., human BACE1 protein) and thereby reduce or inhibit production and/or aggregation of amyloid-β peptides (e.g., in a brain of a subject) are provided. In some embodiments, the antibody or antigen-binding portion thereof reduces or inhibits amyloid-β peptide production. In some embodiments, the antibody or antigen-binding portion thereof reduces or inhibits amyloid-β peptide aggregation. In some embodiments, the antibody or antigen-binding portion thereof reduces or inhibits amyloid-β peptide production and aggregation. In some embodiments, the antibody or antigen-binding portion thereof reduces or inhibits production and/or aggregation of amyloid-β peptides, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of amyloid-β production and/or aggregation in the absence of the anti-BACE1 antibody).

In another aspect, antibodies and antigen-binding portions thereof that bind to a BACE1 protein (e.g., human BACE1 protein) and thereby prevent, reduce, or inhibit the formation of amyloid plaques (e.g., in a brain of a subject) are provided. In some embodiments, the antibody or antigen-binding portion thereof prevents, reduces, or inhibits the formation of amyloid plaques, e.g., by at least 10%, 15%, 20%, 25%, 30%, 35%, 40%, 45%, 50%, 55%, 60%, 65%, 70%, 75%, 80%, 85%, 90%, or 95% (e.g., compared to the amount of amyloid plaque formation in the absence of the anti-BACE1 antibody).

In another aspect, antibodies and antigen-binding portions thereof that bind to a BACE1 protein (e.g., human BACE1 protein) and thereby prevent or treat a neurodegenerative disease (e.g., in a subject) are provided.

In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

In some embodiments, the antibody or antigen-binding portion thereof slows the progression of symptoms of a neurodegenerative disease (e.g., in a subject). In some embodiments, the antibody or antigen-binding portion thereof causes the reversal of symptoms of a neurodegenerative disease. As non-limiting examples, symptoms of a neurodegenerative disease include memory deficits, cognitive deficits, motor deficits, sensory deficits, and speech deficits.

In some embodiments, an anti-BACE1 antibody or antigen-binding portion thereof described herein recognizes an epitope that is the same or substantially the same as the epitope recognized by antibody clone 3G10, 2E1, 1B4, 1A12, 1D7, 1A5, 1H6, 4H10, 3C11, 4A4, 1D2, 2G7, 5A4, 1B1, 1F1, 106, 1F7, 1D10, 4B1, 1F8, 2B8, 1E7, or 2H8. As used herein, the term "substantially the same," as used with reference to an epitope recognized by an antibody clone as described herein, means that the anti-BACE1 antibody recognizes an epitope that is identical, within, or nearly identical to (e.g., has at least 90% sequence identity to, or has one, two, or three amino acid substitutions, e.g., conservative substitutions, relative to), or has substantial overlap with (e.g., at least 50%, 60%, 70%, 80%, 90%, or 95% overlap with) the epitope recognized by the antibody clone as described herein.

Binding Characteristics of Anti-BACE1 Antibodies

In some embodiments, an antibody binds to BACE1 protein (e.g., human BACE1 protein) with high affinity. In some embodiments, the antibody has a binding affinity ($K_D$) for BACE1 protein of less than about 75 nM, e.g., less than about 70 nM, less than about 65 nM, less than about 60 nM, less than about 55 nM, less than about 50 nM, less than about 45 nM, less than about 40 nM, less than about 35 nM, less than about 30 nM, less than about 25 nM, less than about 20 nM, less than about 15 nM, less than about 10 nM, less than about 5 nM, less than about 1 nM, less than about 500 pM, less than about 250 pM, less than about 150 pM, less than about 100 pM, less than about 50 pM, less than about 40 pM, less than about 30 pM, less than about 20 pM, less than about 10 pM, or less than about 5 pM. In some embodiments, the antibody has a $K_D$ for BACE1 protein in the range of about 50 pM to about 75 nM, e.g., about 50 pM to about 70 nM, about 50 pM to about 60 nM, about 50 pM to about 50 nM, about 50 pM to about 40 nM, about 50 pM to about 30 nM, about 50 pM to about 20 nM, about 50 pM to about 10 nM, about 50 pM to about 5 nM, about 50 pM to about 1 nM, about 50 pM to about 500 pM, about 5 pM to about 250 pM, or about 10 pM to about 100 pM.

In some embodiments, an anti-BACE1 antibody specifically binds to one or more splice isoforms of human BACE1 protein (e.g., one, two, three, four, five, or all six of the splice isoforms A, B, C, D, 5, and 6) with high affinity. In some embodiments, the antibody has a $K_D$ for one or more splice isoforms of human BACE1 protein of less than about 75 nM, e.g., less than about 70 nM, less than about 65 nM, less than about 60 nM, less than about 55 nM, less than about 50 nM, less than about 45 nM, less than about 40 nM, less than about 35 nM, less than about 30 nM, less than about 25 nM, less than about 20 nM, less than about 15 nM, less than about 10 nM, less than about 5 nM, less than about 1 nM, less than about 500 pM, less than about 250 pM, less than about 150 pM, less than about 100 pM, less than about 50 pM, less than about 40 pM, less than about 30 pM, less than about 20 pM, less than about 10 pM, or less than about 5 pM. In some embodiments, the antibody has a $K_D$ for one or more splice isoforms of human BACE1 protein that is in the range of about 50 pM to about 75 nM, e.g., about 50 pM to about 70 nM, about 50 pM to about 60 nM, about 50 pM to about 50 nM, about 50 pM to about 40 nM, about 50 pM to about 30 nM, about 50 pM to about 20 nM, about 50 pM to about 10 nM, about 50 pM to about 5 nM, about 50 pM to about 1 nM, about 50 pM to about 500 pM, about 50 pM to about 250 pM, or about 50 pM to about 100 pM.

In some embodiments, the anti-BACE1 antibody exhibits cross-reactivity with cynomolgus monkey ("cyno") BACE1 protein. In some embodiments, the anti-BACE1 antibody exhibits cross-reactivity with mouse BACE1 protein. In some embodiments, the anti-BACE1 antibody exhibits cross-reactivity with cynomolgus monkey BACE1 protein and mouse BACE1 protein.

Methods for analyzing binding affinity, binding kinetics, and cross-reactivity are known in the art. These methods include, but are not limited to, solid-phase binding assays (e.g., ELISA assay), immunoprecipitation, surface plasmon resonance (e.g., Biacore™ (GE Healthcare, Piscataway, N.J.)), kinetic exclusion assays (e.g., KinExA®), flow cytometry, fluorescence-activated cell sorting (FACS), Bio-Layer interferometry (e.g., Octet™ (FortéBio, Inc., Menlo Park, Calif.)), and Western blot analysis. In some embodiments, ELISA is used to determine binding affinity and/or cross-reactivity. Methods for performing ELISA assays are known in the art, and are also described in the Examples section below. In some embodiments, surface plasmon resonance (SPR) is used to determine binding affinity, binding kinetics, and/or cross-reactivity. In some embodiments, kinetic exclusion assays are used to determine binding affinity, binding kinetics, and/or cross-reactivity. In some embodiments, BioLayer interferometry assays are used to determine binding affinity, binding kinetics, and/or cross-reactivity.

Anti-Bace1 Antibody Sequences

In some embodiments, an antibody or antigen-binding portion thereof that specifically binds to a human BACE1 protein comprises a light chain sequence, or a portion thereof, and/or a heavy chain sequence, or a portion thereof, derived from any of the following antibodies described herein: Clone 3G10, Clone 2E1, Clone 1B4, Clone 1A12, Clone 1D7, Clone 1A5, Clone 1H6, Clone 4H10, Clone 3C11, Clone 4A4, Clone 1D2, Clone 2G7, Clone 5A4, Clone 1B1, Clone 1F1, Clone 1C6, Clone 1F7, Clone 1D10, Clone 4B1, Clone 1F8, Clone 2B8, Clone 1E7, and Clone 2H8. The amino acid sequences of the light chain variable region (VL) and heavy chain variable region (VH) of the anti-BACE1 antibodies Clone 3G10, Clone 2E1, Clone 1B4, Clone 1A12, Clone 1D7, Clone 1A5, Clone 1H6, Clone 4H10, Clone 3C11, Clone 4A4, Clone 1D2, Clone 2G7, Clone 5A4, Clone 1B1, Clone 1F1, Clone 106, Clone 1F7, Clone 1D10, Clone 4B1, Clone 1F8, Clone 2B8, Clone 1E7, and Clone 2H8 are set forth in Table 12 below.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:1-28, 310-315, 448-462, and 464-465. In some embodiments, an anti-BACE1 antibody comprises a heavy chain variable region comprising the amino acid sequence of any one of SEQ ID NOs:1-28, 310-315, 448-462, and 464-465. In some embodiments, a heavy chain variable region sequence having at least 90% sequence identity to a reference sequence (e.g., SEQ ID NOs:1-28, 310-315, 448-462, or 464-465) contains one, two, three, four, five, six, seven, eight, nine, ten or more substitutions (e.g., conservative substitutions), insertions, or deletions relative to the reference sequence but retains the ability to specifically bind to a human BACE1 protein. In some embodiments, a heavy chain variable region contains one, two, or three substitutions (e.g., conservative substitutions) in any one of SEQ ID NOs:1-28, 310-315, 448-462, and 464-465.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:101-128, 316-320, 437-447, and 463. In some embodiments, an anti-BACE antibody comprises a light chain variable region comprising the amino acid sequence of any one of SEQ ID NOs:101-128, 316-320, 437-447, and 463. In some embodiments, a light chain variable region sequence having at least 90% sequence identity to a reference sequence (e.g., SEQ ID NOs:101-128, 316-320, 437-447, or 463) contains one, two, three, four, five, six, seven, eight, nine, ten or more substitutions (e.g., conservative substitutions), insertions, or deletions relative to the reference sequence but retains the ability to bind to a human BACE1 protein. In some embodiments, a light chain variable region contains one, two, or three substitutions (e.g., conservative substitutions) in any one of SEQ ID NOs:101-128, 316-320, 437-447, and 463.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:1-28, 310-315, 448-462, and 464-465 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:101-128, 316-320, 437-447, and 463. In some embodiments, an anti-BACE1 antibody comprises a heavy chain variable region comprising the amino acid sequence of any one of SEQ ID NOs:

1-28, 310-315, 448-462, and 464-465 and further comprises a light chain variable region comprising the amino acid sequence of any one of SEQ ID NOs:101-128, 316-320, 437-447, and 463.

In some embodiments, an anti-BACE1 antibody comprises one or more CDRs selected from the group consisting of: (a) a heavy chain CDR1 having at least 90% sequence identity to the amino acid sequence of any one of SEQ ID NOs:29-50, 409-414, and 433-434 or having up to two amino acid substitutions relative to the amino acid sequence of any one of SEQ ID NOs:29-50, 409-414, and 433-434; (b) a heavy chain CDR2 having at least 90% sequence identity to the amino acid sequence of any one of SEQ ID NOs:51-77, 415-422, and 435-436 or having up to two amino acid substitutions relative to the amino acid sequence of any one of SEQ ID NOs:51-77, 415-422, and 435-436; (c) a heavy chain CDR3 having at least 90% sequence identity to the amino acid sequence of any one of SEQ ID NOs:78-100, 178, 423-429 and 466 or having up to two amino acid substitutions relative to the amino acid sequence of any one of SEQ ID NOs:78-100, 178, 423-429 and 466; (d) a light chain CDR1 having at least 90% sequence identity to the amino acid sequence of any one of SEQ ID NOs:129-144, 179-181, 393-394, and 467-469 or having up to two amino acid substitutions relative to the amino acid sequence of any one of SEQ ID NOs:129-144, 179-181, 393-394, and 467-469; (e) a light chain CDR2 having at least 90% sequence identity to the amino acid sequence of any one of SEQ ID NOs:145-157, 182, 395-402, 430-431, and 470 or having up to two amino acid substitutions relative to the amino acid sequence of any one of SEQ ID NOs:145-157, 182, 395-402, 430-431, and 470; and (f) a light chain CDR3 having at least 90% sequence identity to the amino acid sequence of any one of SEQ ID NOs:158-177, 403-408, and 432 or having up to two amino acid substitutions relative to the amino acid sequence of any one of SEQ ID NOs:158-177, 403-408, and 432.

In some embodiments, an anti-BACE1 antibody comprises two, three, four, five, or all six of (a)-(f). In some embodiments, an anti-BACE1 antibody comprises the heavy chain CDR1 of (a), the heavy chain CDR2 of (b), and the heavy chain CDR3 of (c). In some embodiments, an anti-BACE1 antibody comprises the light chain CDR1 of (d), the light chain CDR2 of (e), and the light chain CDR3 of (f). In some embodiments, a CDR having up to two amino acid substitutions has one amino acid substitution relative to the reference sequence. In some embodiments, a CDR having up to two amino acid substitutions has two amino acid substitutions relative to the reference sequence. In some embodiments, the up to two amino acid substitutions are conservative substitutions.

In some embodiments, an anti-BACE1 antibody comprises one or more CDRs selected from the group consisting of: (a) a heavy chain CDR1 comprising the amino acid sequence of any one of SEQ ID NOs:29-50, 409-414, and 433-434; (b) a heavy chain CDR2 comprising the amino acid sequence of any one of SEQ ID NOs:51-77, 415-422, and 435-436; (c) a heavy chain CDR3 comprising the amino acid sequence of any one of SEQ ID NOs:78-100, 178, 423-429 and 466; (d) a light chain CDR1 comprising the amino acid sequence of any one of SEQ ID NOs:129-144, 179-181, 393-394, and 467-469; (e) a light chain CDR2 comprising the amino acid sequence of any one of SEQ ID NOs:145-157, 182, 395-402, 430-431, and 470; and (f) a light chain CDR3 comprising the amino acid sequence of any one of SEQ ID NOs:158-177, 403-408, and 432.

In some embodiments, an anti-BACE1 antibody comprises two, three, four, five, or all six of (a)-(f). In some embodiments, an anti-BACE1 antibody comprises the heavy chain CDR1 of (a), the heavy chain CDR2 of (b), and the heavy chain CDR3 of (c). In some embodiments, an anti-BACE1 antibody comprises the light chain CDR1 of (d), the light chain CDR2 of (e), and the light chain CDR3 of (f).

In some embodiments, an anti-BACE1 antibody comprises one or more sequences that are variants of one or more consensus sequences or are encompassed by one or more consensus sequences. As a non-limiting example, consensus sequences can be identified by aligning heavy chain or light chain sequences (e.g., CDRs) for antibodies that are from the same (or similar) germlines, and optionally are already known to contain sequences that are of the same (or similar) length and/or have at least one highly similar CDR (e.g., highly similar CDR3), to determine conserved amino acids or motifs (i.e., where alteration in sequences may alter protein function) and regions where variation occurs in alignment of sequences (i.e., where variation of sequence is not likely to significantly affect protein function). Alternatively, consensus sequences can be identified by aligning heavy chain or light chain sequences (e.g., CDRs) for antibodies that bind to the same or similar (e.g., overlapping) epitopes to determine conserved amino acids or motifs (i.e., where alteration in sequences may alter protein function) and regions where variation occurs in alignment of sequences (i.e., where variation of sequence is not likely to significantly affect protein function). Exemplary consensus sequences include SEQ ID NOs:178-182, 393-394, 401-402, 407-408, 413-414, 421-422, 428-436, and 466-470. In the consensus sequences of SEQ ID NOs178-182, 393, 401, 407, 413, 421, 428, 430, 433, and 435, the capitalized letter represents an amino acid residue that is absolutely conserved among the aligned sequences (e.g., aligned CDR sequences), while "x" represents an amino acid residue that is not absolutely conserved among the aligned sequences. It will be appreciated that when selecting an amino acid to insert at a position marked by an "x" that in some embodiments, the amino acid is selected from those amino acids found at the corresponding position in the aligned sequences.

In some embodiments, the antibody comprises a heavy chain CDR3 sequence having the consensus sequence xRxxxxxxxxFxY (SEQ ID NO:178). In some embodiments, the heavy chain CDR3 consensus sequence comprises the sequence [V/T]R[G/A/R][G/Y/I/S][Y/R][S/T/L][N/G][Y/H][W/V/Y]F[D/A/S/P]Y (SEQ ID NO:466).

In some embodiments, the antibody comprises a light chain CDR1 sequence having the consensus sequence KASQxVxxxVA (SEQ ID NO:179). In some embodiments, the light chain CDR1 consensus sequence comprises the sequence KASQ[D/N]V[G/S][T/R/S][N/A]VA (SEQ ID NO:467).

In some embodiments, the antibody comprises a light chain CDR1 sequence having the consensus sequence QSxVHSNGxTYLx (SEQ ID NO:180). In some embodiments, the light chain CDR1 consensus sequence comprises the sequence QS[L/I]VHSNG[N/Y]TYL[H/E] (SEQ ID NO:468).

In some embodiments, the antibody comprises a light chain CDR1 sequence having the consensus sequence QxISxYLx (SEQ ID NO:181). In some embodiments, the light chain CDR1 consensus sequence comprises the sequence Q[D/S]IS[N/K/D]YL[N/H] (SEQ ID NO:469).

In some embodiments, the antibody comprises a light chain CDR2 sequence having the consensus sequence xTSxLxS (SEQ ID NO:182). In some embodiments, the light chain CDR2 consensus sequence comprises the sequence [Y/A]TS[N/R]L[H/A]S (SEQ ID NO:470).

In some embodiments, the antibody comprises a light chain CDR1 sequence having the consensus sequence KASQxVGxNVA (SEQ ID NO:393). In some embodiments, the light chain CDR1 consensus sequence comprises the sequence KASQ[D/N]VG[R/S/T]NVA (SEQ ID NO:394).

In some embodiments, the antibody comprises a light chain CDR2 sequence having the consensus sequence SASxxYS (SEQ ID NO:401). In some embodiments, the light chain CDR2 consensus sequence comprises the sequence SAS[H/Y][R/Y/N/M/Q/K/L/W]YS (SEQ ID NO:402).

In some embodiments, the antibody comprises a light chain CDR2 sequence having the consensus sequence SASHxYS (SEQ ID NO:430). In some embodiments, the light chain CDR2 consensus sequence comprises the sequence SASH[R/Y/N/M/Q/K/L]YS (SEQ ID NO:431).

In some embodiments, the antibody comprises a light chain CDR3 sequence having the consensus sequence QQYxxYxYT (SEQ ID NO:407). In some embodiments, the light chain CDR3 consensus sequence comprises the sequence QQY[N/S/Q/Y][S/A]Y[P/A/M]YT (SEQ ID NO:408). In some embodiments, the light chain CDR3 consensus sequence comprises the sequence QQY[N/S/Q/Y][S/A]Y[P/A]YT (SEQ ID NO:432).

In some embodiments, the antibody comprises a heavy chain CDR1 sequence having the consensus sequence GYTFxxxxxH (SEQ ID NO:413). In some embodiments, the heavy chain CDR1 consensus sequence comprises the sequence GYTF[T/N][N/S][F/Y][W/Y][I/M]H (SEQ ID NO:414).

In some embodiments, the antibody comprises a heavy chain CDR1 sequence having the consensus sequence GYTFxxxxIH (SEQ ID NO:433). In some embodiments, the heavy chain CDR1 consensus sequence comprises the sequence GYTF[T/N][N/S][F/Y][W/Y]IH (SEQ ID NO:434).

In some embodiments, the antibody comprises a heavy chain CDR2 sequence having the consensus sequence xIDPxxxxxxxxNQxxKx (SEQ ID NO:421). In some embodiments, the heavy chain CDR2 consensus sequence comprises the sequence [M/I]IDP[S/D][D/S/E/G/A][S/A/T/N/D][Y/D][T/I][K/N][Y/F/N]NQ[K/N][F/L]K[A/G/D] (SEQ ID NO:422).

In some embodiments, the antibody comprises a heavy chain CDR2 sequence having the consensus sequence xIDPxxxYTKYNQKFKA (SEQ ID NO:435). In some embodiments, the heavy chain CDR2 consensus sequence comprises the sequence [M/I]IDP[S/D][D/S/E/G][S/A]YTKYNQKFKA (SEQ ID NO:436).

In some embodiments, the antibody comprises a heavy chain CDR3 sequence having the consensus sequence ARSGxxxPx (SEQ ID NO:428). In some embodiments, the heavy chain CDR3 consensus sequence comprises the sequence ARSG[V/A/G][A/S][F/L]P[Y/S] (SEQ ID NO:429).

3G10

In some embodiments, an anti-BACE1 antibody comprises a heavy chain CDR1 sequence comprising the amino acid sequence of SEQ ID NO:29, a heavy chain CDR2 sequence comprising the amino acid sequence of SEQ ID NO:51, and a heavy chain CDR3 sequence comprising the amino acid sequence of SEQ ID NO:78. In some embodiments, an anti-BACE1 antibody comprises a light chain CDR1 sequence comprising the amino acid sequence of SEQ ID NO:129, a light chain CDR2 sequence comprising the amino acid sequence of SEQ ID NO:145, and a light chain CDR3 sequence comprising the amino acid sequence of SEQ ID NO:158. In some embodiments, an anti-BACE1 antibody comprises a heavy chain CDR1-3 and a light chain CDR1-3 comprising the amino acid sequences of SEQ ID NOs:29, 51, 78, 129, 145, and 158, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:1. In some embodiments, an anti-BACE1 antibody comprises a heavy chain variable region comprising the amino acid sequence of SEQ ID NO:1.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:101. In some embodiments, an anti-BACE1 antibody comprises a light chain variable region comprising the amino acid sequence of SEQ ID NO:101.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:1 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:101. In some embodiments, an anti-BACE1 antibody comprises a heavy chain variable region comprising the amino acid sequence of SEQ ID NO:1 and further comprises a light chain variable region comprising the amino acid sequence of SEQ ID NO:101.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:29, 51, 78, 129, 145, and 158, respectively, or an antibody comprising a heavy chain variable region comprising the amino acid sequence of SEQ ID NO:1 and further comprising a light chain variable region comprising the amino acid sequence of SEQ ID NO:101).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:1 and (ii) a CDR-H1, CDR-H2, and CDR-H3 that is identical to SEQ ID NOs:29, 51, and 78, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:101 and (ii) a CDR-L1, CDR-L2, and CDR-L3 that is identical to SEQ ID NOs:129, 145, and 158, respectively.

2E1

In some embodiments, an anti-BACE1 antibody comprises a heavy chain CDR1 sequence comprising the amino acid sequence of SEQ ID NO:30, a heavy chain CDR2 sequence comprising the amino acid sequence of SEQ ID NO:52, and a heavy chain CDR3 sequence comprising the amino acid sequence of SEQ ID NO:79. In some embodiments, an anti-BACE1 antibody comprises a light chain CDR1 sequence comprising the amino acid sequence of SEQ ID NO:130, a light chain CDR2 sequence comprising the amino acid sequence of SEQ ID NO:146, and a light chain CDR3 sequence comprising the amino acid sequence of SEQ ID NO:159. In some embodiments, an anti-BACE1 antibody comprises a heavy chain CDR1-3 and a light chain CDR1-3 comprising the amino acid sequences of SEQ ID NOs:30, 52, 79, 130, 146, and 159, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:2. In some embodiments, an anti-BACE1 antibody comprises a heavy chain variable region comprising the amino acid sequence of SEQ ID NO:2.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:102. In some embodiments, an anti-BACE1 antibody comprises a light chain variable region comprising the amino acid sequence of SEQ ID NO:102.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:2 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:102. In some embodiments, an anti-BACE1 antibody comprises a heavy chain variable region comprising the amino acid sequence of SEQ ID NO:2 and further comprises a light chain variable region comprising the amino acid sequence of SEQ ID NO:102.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:30, 52, 79, 130, 46, and 59, respectively, or an antibody comprising a heavy chain variable region comprising the amino acid sequence of SEQ ID NO:2 and further comprising a light chain variable region comprising the amino acid sequence of SEQ ID NO:102).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:2 and (ii) a CDR-H1, CDR-H2, and CDR-H3 that is identical to SEQ ID NOs:30, 52, and 79, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:102 and (ii) a CDR-L1, CDR-L2, and CDR-L3 that is identical to SEQ ID NOs:130, 146, and 159, respectively.

1B4

In some embodiments, an anti-BACE1 antibody comprises a heavy chain CDR1 sequence comprising the amino acid sequence of SEQ ID NO:31, a heavy chain CDR2 sequence comprising the amino acid sequence of SEQ ID NO:53, and a heavy chain CDR3 sequence comprising the amino acid sequence of SEQ ID NO:80. In some embodiments, an anti-BACE1 antibody comprises a light chain CDR1 sequence comprising the amino acid sequence of SEQ ID NO:131, a light chain CDR2 sequence comprising the amino acid sequence of SEQ ID NO:147, and a light chain CDR3 sequence comprising the amino acid sequence of SEQ ID NO:160. In some embodiments, an anti-BACE1 antibody comprises a heavy chain CDR1-3 and a light chain CDR1-3 comprising the amino acid sequences of SEQ ID NOs:31, 53, 80, 131, 147, and 160, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:3. In some embodiments, an anti-BACE1 antibody comprises a heavy chain variable region comprising the amino acid sequence of SEQ ID NO:3.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:103. In some embodiments, an anti-BACE1 antibody comprises a light chain variable region comprising the amino acid sequence of SEQ ID NO:103.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:3 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:103. In some embodiments, an anti-BACE1 antibody comprises a heavy chain variable region comprising the amino acid sequence of SEQ ID NO:3 and further comprises a light chain variable region comprising the amino acid sequence of SEQ ID NO:103.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:31, 53, 80, 131, 147, and 160, respectively, or an antibody comprising a heavy chain variable region comprising the amino acid sequence of SEQ ID NO:3 and further comprising a light chain variable region comprising the amino acid sequence of SEQ ID NO:103).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:3 and (ii)

a CDR-H1, CDR-H2, and CDR-H3 that is identical to SEQ ID NOs:31, 53, and 80, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:103 and (ii) a CDR-L1, CDR-L2, and CDR-L3 that is identical to SEQ ID NOs:131, 147, and 160, respectively.

1A12

In some embodiments, an anti-BACE1 antibody comprises a heavy chain CDR1 sequence comprising the amino acid sequence of SEQ ID NO:32, a heavy chain CDR2 sequence comprising the amino acid sequence of SEQ ID NO:54, and a heavy chain CDR3 sequence comprising the amino acid sequence of SEQ ID NO:81. In some embodiments, an anti-BACE1 antibody comprises a light chain CDR1 sequence comprising the amino acid sequence of SEQ ID NO:132, a light chain CDR2 sequence comprising the amino acid sequence of SEQ ID NO:148, and a light chain CDR3 sequence comprising the amino acid sequence of SEQ ID NO:161. In some embodiments, an anti-BACE1 antibody comprises a heavy chain CDR1-3 and a light chain CDR1-3 comprising the amino acid sequences of SEQ ID NOs:32, 54, 81, 132, 148, and 161, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:4. In some embodiments, an anti-BACE1 antibody comprises a heavy chain variable region comprising the amino acid sequence of SEQ ID NO:4.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:104. In some embodiments, an anti-BACE1 antibody comprises a light chain variable region comprising the amino acid sequence of SEQ ID NO:104.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:4 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:104. In some embodiments, an anti-BACE1 antibody comprises a heavy chain variable region comprising the amino acid sequence of SEQ ID NO:4 and further comprises a light chain variable region comprising the amino acid sequence of SEQ ID NO:104.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:32, 54, 81, 132, 148, and 161, respectively, or an antibody comprising a heavy chain variable region comprising the amino acid sequence of SEQ ID NO:4 and further comprising a light chain variable region comprising the amino acid sequence of SEQ ID NO:104).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:4 and (ii) a CDR-H1, CDR-H2, and CDR-H3 that is identical to SEQ ID NOs:32, 54, and 81, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:104 and (ii) a CDR-L1, CDR-L2, and CDR-L3 that is identical to SEQ ID NOs:132, 148, and 161, respectively.

1D7

In some embodiments, an anti-BACE1 antibody comprises a heavy chain CDR1 sequence comprising the amino acid sequence of SEQ ID NO:33, a heavy chain CDR2 sequence comprising the amino acid sequence of SEQ ID NO:55, and a heavy chain CDR3 sequence comprising the amino acid sequence of SEQ ID NO:82. In some embodiments, an anti-BACE1 antibody comprises a light chain CDR1 sequence comprising the amino acid sequence of SEQ ID NO:133, a light chain CDR2 sequence comprising the amino acid sequence of SEQ ID NO:147, and a light chain CDR3 sequence comprising the amino acid sequence of SEQ ID NO:162. In some embodiments, an anti-BACE1 antibody comprises a heavy chain CDR1-3 and a light chain CDR1-3 comprising the amino acid sequences of SEQ ID NOs:33, 55, 82, 133, 147, and 162, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:5. In some embodiments, an anti-BACE1 antibody comprises a heavy chain variable region comprising the amino acid sequence of SEQ ID NO:5.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:105. In some embodiments, an anti-BACE1 antibody comprises a light chain variable region comprising the amino acid sequence of SEQ ID NO:105.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:5 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:105. In some embodiments, an anti-BACE1 antibody comprises a heavy chain variable region comprising the amino acid sequence of SEQ ID NO:5 and further comprises a light chain variable region comprising the amino acid sequence of SEQ ID NO:105.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:33, 55, 82, 133, 147, and 162, respectively, or an antibody comprising a heavy chain variable region comprising the amino acid sequence of SEQ ID NO:5 and further comprising a light chain variable region comprising the amino acid sequence of SEQ ID NO:105).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:5 and (ii) a CDR-H1, CDR-H2, and CDR-H3 that is identical to SEQ ID NOs:33, 55, and 82, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:105 and (ii) a CDR-L1, CDR-L2, and CDR-L3 that is identical to SEQ ID NOs:133, 147, and 162, respectively.

1A5

In some embodiments, an anti-BACE1 antibody comprises a heavy chain CDR1 sequence comprising the amino acid sequence of SEQ ID NO:34, a heavy chain CDR2 sequence comprising the amino acid sequence of SEQ ID NO:56, and a heavy chain CDR3 sequence comprising the amino acid sequence of SEQ ID NO:83. In some embodiments, an anti-BACE1 antibody comprises a light chain CDR1 sequence comprising the amino acid sequence of SEQ ID NO:134, a light chain CDR2 sequence comprising the amino acid sequence of SEQ ID NO:149, and a light chain CDR3 sequence comprising the amino acid sequence of SEQ ID NO:163. In some embodiments, an anti-BACE1 antibody comprises a heavy chain CDR1-3 and a light chain CDR1-3 comprising the amino acid sequences of SEQ ID NOs:34, 56, 83, 134, 149, and 163, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:6. In some embodiments, an anti-BACE1 antibody comprises a heavy chain variable region comprising the amino acid sequence of SEQ ID NO:6.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:106. In some embodiments, an anti-BACE1 antibody comprises a light chain variable region comprising the amino acid sequence of SEQ ID NO:106.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:6 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:106. In some embodiments, an anti-BACE1 antibody comprises a heavy chain variable region comprising the amino acid sequence of SEQ ID NO:6 and further comprises a light chain variable region comprising the amino acid sequence of SEQ ID NO:106.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:34, 56, 83, 134, 149, and 163, respectively, or an antibody comprising a heavy chain variable region comprising the amino acid sequence of SEQ ID NO:6 and further comprising a light chain variable region comprising the amino acid sequence of SEQ ID NO:106).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:6 and (ii) a CDR-H1, CDR-H2, and CDR-H3 that is identical to SEQ ID NOs:34, 56, and 83, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:106 and (ii) a CDR-L1, CDR-L2, and CDR-L3 that is identical to SEQ ID NOs:134, 149, and 163, respectively.

1H6

In some embodiments, an anti-BACE1 antibody comprises a heavy chain CDR1 sequence comprising the amino acid sequence of SEQ ID NO:35, a heavy chain CDR2 sequence comprising the amino acid sequence of SEQ ID NO:57, and a heavy chain CDR3 sequence comprising the amino acid sequence of SEQ ID NO:84. In some embodiments, an anti-BACE1 antibody comprises a light chain CDR1 sequence comprising the amino acid sequence of SEQ ID NO:135, a light chain CDR2 sequence comprising the amino acid sequence of SEQ ID NO:148, and a light chain CDR3 sequence comprising the amino acid sequence of SEQ ID NO:164. In some embodiments, an anti-BACE1 antibody comprises a heavy chain CDR1-3 and a light chain CDR1-3 comprising the amino acid sequences of SEQ ID NOs:35, 57, 84, 135, 148, and 164, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:7. In some embodiments, an anti-BACE1 antibody comprises a heavy chain variable region comprising the amino acid sequence of SEQ ID NO:7.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:107. In some embodiments, an anti-BACE1 antibody comprises a light chain variable region comprising the amino acid sequence of SEQ ID NO:107.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:7 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:107. In some embodiments, an anti-BACE1 antibody comprises a heavy chain variable region comprising the amino acid sequence of SEQ ID NO:7 and further comprises a light chain variable region comprising the amino acid sequence of SEQ ID NO:107.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:35, 57, 84, 135, 148, and 164, respectively, or an antibody comprising a heavy chain variable region comprising the amino acid sequence of SEQ ID NO:7 and further comprising a light chain variable region comprising the amino acid sequence of SEQ ID NO:107).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:7 and (ii) a CDR-H1, CDR-H2, and CDR-H3 that is identical to SEQ ID NOs:35, 57, and 84, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:107 and (ii) a CDR-L1, CDR-L2, and CDR-L3 that is identical to SEQ ID NOs:135, 148, and 164, respectively.

4H10

In some embodiments, an anti-BACE1 antibody comprises a heavy chain CDR1 sequence comprising the amino acid sequence of SEQ ID NO:36, a heavy chain CDR2 sequence comprising the amino acid sequence of SEQ ID NO:58, and a heavy chain CDR3 sequence comprising the amino acid sequence of SEQ ID NO:85. In some embodiments, an anti-BACE1 antibody comprises a light chain CDR1 sequence comprising the amino acid sequence of SEQ ID NO:136, a light chain CDR2 sequence comprising the amino acid sequence of SEQ ID NO:150, and a light chain CDR3 sequence comprising the amino acid sequence of SEQ ID NO:165. In some embodiments, an anti-BACE1 antibody comprises a heavy chain CDR1-3 and a light chain CDR1-3 comprising the amino acid sequences of SEQ ID NOs:36, 58, 85, 136, 150, and 165, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:8. In some embodiments, an anti-BACE1 antibody comprises a heavy chain variable region comprising the amino acid sequence of SEQ ID NO:8.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:108. In some embodiments, an anti-BACE1 antibody comprises a light chain variable region comprising the amino acid sequence of SEQ ID NO:108.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:8 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:108. In some embodiments, an anti-BACE1 antibody comprises a heavy chain variable region comprising the amino acid sequence of SEQ ID NO:8 and further comprises a light chain variable region comprising the amino acid sequence of SEQ ID NO:108.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:36, 58, 85, 136, 150, and 165, respectively, or an antibody comprising a heavy chain variable region comprising the amino acid sequence of SEQ ID NO:8 and further comprising a light chain variable region comprising the amino acid sequence of SEQ ID NO:108).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:8 and (ii) a CDR-H1, CDR-H2, and CDR-H3 that is identical to SEQ ID NOs:36, 58, and 85, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:108 and (ii) a CDR-L1, CDR-L2, and CDR-L3 that is identical to SEQ ID NOs:136, 150, and 165, respectively.

3C11

In some embodiments, an anti-BACE1 antibody comprises a heavy chain CDR1 sequence comprising the amino acid sequence of SEQ ID NO:37, a heavy chain CDR2 sequence comprising the amino acid sequence of SEQ ID NO:59, and a heavy chain CDR3 sequence comprising the amino acid sequence of SEQ ID NO:86. In some embodiments, an anti-BACE1 antibody comprises a light chain CDR1 sequence comprising the amino acid sequence of SEQ ID NO:137, a light chain CDR2 sequence comprising the amino acid sequence of SEQ ID NO:151, and a light chain CDR3 sequence comprising the amino acid sequence of SEQ ID NO:159. In some embodiments, an anti-BACE1 antibody comprises a heavy chain CDR1-3 and a light chain CDR1-3 comprising the amino acid sequences of SEQ ID NOs:37, 59, 86, 137, 151, and 159, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:9. In some embodiments, an anti-BACE1 antibody comprises a heavy chain variable region comprising the amino acid sequence of SEQ ID NO:9.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:109. In some embodiments, an anti-BACE1 antibody comprises a light chain variable region comprising the amino acid sequence of SEQ ID NO:109.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:9 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:109. In some embodiments, an anti-BACE1 antibody comprises a heavy chain variable region comprising the amino acid sequence of SEQ ID NO:9 and further comprises a light chain variable region comprising the amino acid sequence of SEQ ID NO:109.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:37, 59, 86, 137, 151, and 159, respectively, or an antibody comprising a heavy chain variable region comprising the amino acid sequence of SEQ ID NO:9 and further comprising a light chain variable region comprising the amino acid sequence of SEQ ID NO:109).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:9 and (ii) a CDR-H1, CDR-H2, and CDR-H3 that is identical to SEQ ID NOs:37, 59, and 86, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:109 and (ii) a CDR-L1, CDR-L2, and CDR-L3 that is identical to SEQ ID NOs:137, 151, and 159, respectively.

4A4

In some embodiments, an anti-BACE1 antibody comprises a heavy chain CDR1 sequence comprising the amino acid sequence of SEQ ID NO:38, a heavy chain CDR2 sequence comprising the amino acid sequence of SEQ ID NO:60, and a heavy chain CDR3 sequence comprising the amino acid sequence of SEQ ID NO:87. In some embodiments, an anti-BACE1 antibody comprises a light chain CDR1 sequence comprising the amino acid sequence of SEQ ID NO:133, a light chain CDR2 sequence comprising the amino acid sequence of SEQ ID NO:147, and a light chain CDR3 sequence comprising the amino acid sequence of SEQ ID NO:166. In some embodiments, an anti-BACE1 antibody comprises a heavy chain CDR1-3 and a light chain CDR1-3 comprising the amino acid sequences of SEQ ID NOs:38, 60, 87, 133, 147, and 166, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:10. In some embodiments, an anti-BACE1 antibody comprises a heavy chain variable region comprising the amino acid sequence of SEQ ID NO:10.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:110. In some embodiments, an anti-BACE1 antibody comprises a light chain variable region comprising the amino acid sequence of SEQ ID NO:110.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:10 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:110. In some embodiments, an anti-BACE1 antibody comprises a heavy chain variable region comprising the amino acid sequence of SEQ ID NO:10 and further comprises a light chain variable region comprising the amino acid sequence of SEQ ID NO:110.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:38, 60, 87, 133, 147, and 166, respectively, or an antibody comprising a heavy chain variable region comprising the amino acid sequence of SEQ ID NO:10 and further comprising a light chain variable region comprising the amino acid sequence of SEQ ID NO:110).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:10 and (ii) a CDR-H1, CDR-H2, and CDR-H3 that is identical to SEQ ID NOs:38, 60, and 87, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:110 and (ii) a CDR-L1, CDR-L2, and CDR-L3 that is identical to SEQ ID NOs:133, 147, and 166, respectively.

1D2

In some embodiments, an anti-BACE1 antibody comprises a heavy chain CDR1 sequence comprising the amino acid sequence of SEQ ID NO:36, a heavy chain CDR2 sequence comprising the amino acid sequence of SEQ ID NO:61, and a heavy chain CDR3 sequence comprising the amino acid sequence of SEQ ID NO:88. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:150, and a light chain CDR3 sequence comprising the amino acid sequence of SEQ ID NO:167. In some embodiments, an anti-BACE1 antibody comprises a heavy chain CDR1-3 and a light chain CDR1-3 comprising the amino acid sequences of SEQ ID NOs:36, 61, 88, 138, 150, and 167, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:11. In some embodiments, an anti-BACE1 antibody comprises a heavy chain variable region comprising the amino acid sequence of SEQ ID NO:11.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:111. In some embodiments, an anti-BACE1 antibody comprises a light chain variable region comprising the amino acid sequence of SEQ ID NO:111.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:11 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:111. In some embodiments, an anti-BACE1 antibody comprises a heavy chain variable region comprising the amino acid sequence of SEQ ID NO:11 and further comprises a light chain variable region comprising the amino acid sequence of SEQ ID NO:111.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:36, 61, 88, 138, 150, and 167, respectively, or an antibody comprising a heavy chain variable region comprising the amino acid sequence of SEQ ID NO:11 and further comprising a light chain variable region comprising the amino acid sequence of SEQ ID NO:111).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:11 and (ii) a CDR-H1, CDR-H2, and CDR-H3 that is identical to SEQ ID NOs:36, 61, and 88, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:111 and (ii) a CDR-L1, CDR-L2, and CDR-L3 that is identical to SEQ ID NOs:138, 150, and 167, respectively.

2G7

In some embodiments, an anti-BACE1 antibody comprises a heavy chain CDR1 sequence comprising the amino acid sequence of SEQ ID NO:39, a heavy chain CDR2 sequence comprising the amino acid sequence of SEQ ID NO:62, and a heavy chain CDR3 sequence comprising the amino acid sequence of SEQ ID NO:89. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:168. In some embodiments, an anti-BACE1 antibody comprises a heavy chain CDR1-3 and a light chain CDR1-3 comprising the amino acid sequences of SEQ ID NOs:39, 62, 89, 138, 152, and 168, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:12. In some embodiments, an anti-BACE1 antibody comprises a heavy chain variable region comprising the amino acid sequence of SEQ ID NO:12.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:112. In some embodiments, an anti-BACE1 antibody comprises a light chain variable region comprising the amino acid sequence of SEQ ID NO:112.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:12 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:112. In some embodiments, an anti-BACE1 antibody comprises a heavy chain variable region comprising the amino acid sequence of SEQ ID NO:12 and further comprises a light chain variable region comprising the amino acid sequence of SEQ ID NO:112.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:39, 62, 89, 138, 152, and 168, respectively, or an antibody comprising a heavy chain variable region comprising the amino acid sequence of SEQ ID NO:12 and further comprising a light chain variable region comprising the amino acid sequence of SEQ ID NO:112).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:12 and (ii) a CDR-H1, CDR-H2, and CDR-H3 that is identical to SEQ ID NOs:39, 62, and 89, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:112 and (ii) a CDR-L1, CDR-L2, and CDR-L3 that is identical to SEQ ID NOs:138, 152, and 168, respectively.

5A4

In some embodiments, an anti-BACE1 antibody comprises a heavy chain CDR1 sequence comprising the amino acid sequence of SEQ ID NO:40, a heavy chain CDR2 sequence comprising the amino acid sequence of SEQ ID NO:63, and a heavy chain CDR3 sequence comprising the amino acid sequence of SEQ ID NO:90. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:153, and a light chain CDR3 sequence comprising the amino acid sequence of SEQ ID NO:169. In some embodiments, an anti-BACE1 antibody comprises a heavy chain CDR1-3 and a light chain CDR1-3 comprising the amino acid sequences of SEQ ID NOs:40, 63, 90, 138, 153, and 169, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:13. In some embodiments, an anti-BACE1 antibody comprises a heavy chain variable region comprising the amino acid sequence of SEQ ID NO:13.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:113. In some embodiments, an anti-BACE1 antibody comprises a light chain variable region comprising the amino acid sequence of SEQ ID NO:113.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:13 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:113. In some embodiments, an anti-BACE1 antibody comprises a heavy chain variable region comprising the amino acid sequence of SEQ ID NO:13 and further comprises a light chain variable region comprising the amino acid sequence of SEQ ID NO:113.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:40, 63, 90, 138, 153, and 169, respectively, or an antibody comprising a heavy chain variable region comprising the amino acid sequence of SEQ ID NO:13 and further comprising a light chain variable region comprising the amino acid sequence of SEQ ID NO:113).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:13 and (ii) a CDR-H1, CDR-H2, and CDR-H3 that is identical to SEQ ID NOs:40, 63, and 90, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:113 and (ii) a CDR-L1, CDR-L2, and CDR-L3 that is identical to SEQ ID NOs:138, 153, and 169, respectively.

1B1

In some embodiments, an anti-BACE1 antibody comprises a heavy chain CDR1 sequence comprising the amino acid sequence of SEQ ID NO:41, a heavy chain CDR2 sequence comprising the amino acid sequence of SEQ ID NO:64, and a heavy chain CDR3 sequence comprising the amino acid sequence of SEQ ID NO:91. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:170. In some embodiments, an anti-BACE1 antibody comprises a heavy chain CDR1-3 and a light chain CDR1-3 comprising the amino acid sequences of SEQ ID NOs:41, 64, 91, 138, 152, and 170, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:14. In some embodiments, an anti-BACE1 antibody comprises a heavy chain variable region comprising the amino acid sequence of SEQ ID NO:14.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:114. In some embodiments, an anti-BACE1 antibody comprises a light chain variable region comprising the amino acid sequence of SEQ ID NO:114.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:14 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:114. In some embodiments, an anti-BACE1 antibody comprises a heavy chain variable region comprising the amino acid sequence of SEQ ID NO:14 and further comprises a light chain variable region comprising the amino acid sequence of SEQ ID NO:114.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:41, 64, 91, 138, 152, and 170, respectively, or an antibody comprising a heavy chain variable region comprising the amino acid sequence of SEQ ID NO:14 and further comprising a light chain variable region comprising the amino acid sequence of SEQ ID NO:114).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:14 and (ii) a CDR-H1, CDR-H2, and CDR-H3 that is identical to SEQ ID NOs:41, 64, and 91, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:114 and (ii) a CDR-L1, CDR-L2, and CDR-L3 that is identical to SEQ ID NOs:138, 152, and 170, respectively.

1F1

In some embodiments, an anti-BACE1 antibody comprises a heavy chain CDR1 sequence comprising the amino acid sequence of SEQ ID NO:42, a heavy chain CDR2 sequence comprising the amino acid sequence of SEQ ID NO:65, and a heavy chain CDR3 sequence comprising the amino acid sequence of SEQ ID NO:92. In some embodiments, an anti-BACE1 antibody comprises a light chain CDR1 sequence comprising the amino acid sequence of SEQ ID NO:139, a light chain CDR2 sequence comprising the amino acid sequence of SEQ ID NO:148, and a light chain CDR3 sequence comprising the amino acid sequence of SEQ ID NO:171. In some embodiments, an anti-BACE1 antibody comprises a heavy chain CDR1-3 and a light chain CDR1-3 comprising the amino acid sequences of SEQ ID NOs:42, 65, 92, 139, 148, and 171, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:15. In some embodiments, an anti-BACE1 antibody comprises a heavy chain variable region comprising the amino acid sequence of SEQ ID NO:15.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:115. In some embodiments, an anti-BACE1 antibody comprises a light chain variable region comprising the amino acid sequence of SEQ ID NO:115.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:15 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:115. In some embodiments, an anti-BACE1 antibody comprises a heavy chain variable region comprising the amino acid sequence of SEQ ID NO:15 and further comprises a light chain variable region comprising the amino acid sequence of SEQ ID NO:115.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:42, 65, 92, 139, 148, and 171, respectively, or an antibody comprising a heavy chain variable region comprising the amino acid sequence of SEQ ID NO:15 and further comprises a light chain variable region comprising the amino acid sequence of SEQ ID NO:115).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:15 and (ii) a CDR-H1, CDR-H2, and CDR-H3 that is identical to SEQ ID NOs:42, 65, and 92, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:115 and (ii) a CDR-L1, CDR-L2, and CDR-L3 that is identical to SEQ ID NOs:139, 148, and 171, respectively.

1C6

In some embodiments, an anti-BACE1 antibody comprises a heavy chain CDR1 sequence comprising the amino acid sequence of SEQ ID NO:34, a heavy chain CDR2 sequence comprising the amino acid sequence of SEQ ID NO:66, and a heavy chain CDR3 sequence comprising the amino acid sequence of SEQ ID NO:93. In some embodiments, an anti-BACE1 antibody comprises a light chain CDR1 sequence comprising the amino acid sequence of SEQ ID NO:134, a light chain CDR2 sequence comprising the amino acid sequence of SEQ ID NO:149, and a light chain CDR3 sequence comprising the amino acid sequence of SEQ ID NO:172. In some embodiments, an anti-BACE1 antibody comprises a heavy chain CDR1-3 and a light chain CDR1-3 comprising the amino acid sequences of SEQ ID NOs:34, 66, 93, 134, 149, and 172, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:16. In some embodiments, an anti-BACE1 antibody comprises a heavy chain variable region comprising the amino acid sequence of SEQ ID NO:16.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:116. In some embodiments, an anti-BACE1 antibody comprises a light chain variable region comprising the amino acid sequence of SEQ ID NO:116.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:16 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:116. In some embodiments, an anti-BACE1 antibody comprises a heavy chain variable region comprising the amino acid sequence of SEQ ID NO:16 and further comprises a light chain variable region comprising the amino acid sequence of SEQ ID NO:116.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:34, 66, 93, 134, 149, and 172, respectively, or an antibody comprising a heavy chain variable region comprising the amino acid sequence of SEQ ID NO:16 and further comprising a light chain variable region comprising the amino acid sequence of SEQ ID NO:116).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:16 and (ii) a CDR-H1, CDR-H2, and CDR-H3 that is identical to SEQ ID NOs:34, 66, and 93, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:116 and (ii) a CDR-L1, CDR-L2, and CDR-L3 that is identical to SEQ ID NOs:134, 149, and 172, respectively.

1F7

In some embodiments, an anti-BACE1 antibody comprises a heavy chain CDR1 sequence comprising the amino acid sequence of SEQ ID NO:43, a heavy chain CDR2 sequence comprising the amino acid sequence of SEQ ID NO:67, and a heavy chain CDR3 sequence comprising the amino acid sequence of SEQ ID NO:94. In some embodiments, an anti-BACE1 antibody comprises a light chain CDR1 sequence comprising the amino acid sequence of SEQ ID NO:140, a light chain CDR2 sequence comprising the amino acid sequence of SEQ ID NO:154, and a light chain CDR3 sequence comprising the amino acid sequence of SEQ ID NO:173. In some embodiments, an anti-BACE1 antibody comprises a heavy chain CDR1-3 and a light chain CDR1-3 comprising the amino acid sequences of SEQ ID NOs:43, 67, 94, 140, 154, and 173, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:17. In some embodiments, an anti-BACE1 antibody comprises a heavy chain variable region comprising the amino acid sequence of SEQ ID NO:17.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:117. In some embodiments, an anti-BACE1 antibody comprises a light chain variable region comprising the amino acid sequence of SEQ ID NO:117.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:17 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:117. In some embodiments, an anti-BACE1 antibody comprises a heavy chain variable region comprising the amino acid sequence of SEQ ID NO:17 and further comprises a light chain variable region comprising the amino acid sequence of SEQ ID NO:117.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:43, 67, 94, 140, 154, and 173, respectively, or an antibody comprising a heavy chain variable region comprising the amino acid sequence of SEQ ID NO:17 and further comprising a light chain variable region comprising the amino acid sequence of SEQ ID NO:117).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:17 and (ii) a CDR-H1, CDR-H2, and CDR-H3 that is identical to SEQ ID NOs:43, 67, and 94, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:117 and (ii) a CDR-L1, CDR-L2, and CDR-L3 that is identical to SEQ ID NOs:140, 154, and 173, respectively.

1D10

In some embodiments, an anti-BACE1 antibody comprises a heavy chain CDR1 sequence comprising the amino acid sequence of SEQ ID NO:44, a heavy chain CDR2 sequence comprising the amino acid sequence of SEQ ID NO:68, and a heavy chain CDR3 sequence comprising the amino acid sequence of SEQ ID NO:95. In some embodiments, an anti-BACE1 antibody comprises a light chain CDR1 sequence comprising the amino acid sequence of SEQ ID NO:141, a light chain CDR2 sequence comprising the amino acid sequence of SEQ ID NO:155, and a light chain CDR3 sequence comprising the amino acid sequence of SEQ ID NO:174. In some embodiments, an anti-BACE1 antibody comprises a heavy chain CDR1-3 and a light chain CDR1-3 comprising the amino acid sequences of SEQ ID NOs:44, 68, 95, 141, 155, and 174, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:18. In some embodiments, an anti-BACE1 antibody comprises a heavy chain variable region comprising the amino acid sequence of SEQ ID NO:18.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:118. In some embodiments, an anti-BACE1 antibody comprises a light chain variable region comprising the amino acid sequence of SEQ ID NO:118.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:18 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:118. In some embodiments, an anti-BACE1 antibody comprises a heavy chain variable region comprising the amino acid sequence of SEQ ID NO:18 and further comprises a light chain variable region comprising the amino acid sequence of SEQ ID NO:118.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:44, 68, 95, 141, 155, and 174, respectively, or an antibody comprising a heavy chain variable region comprising the amino acid sequence of SEQ ID NO:18 and further comprising a light chain variable region comprising the amino acid sequence of SEQ ID NO:118).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:18 and (ii) a CDR-H1, CDR-H2, and CDR-H3 that is identical to SEQ ID NOs:44, 68, and 95, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:118 and (ii) a CDR-L1, CDR-L2, and CDR-L3 that is identical to SEQ ID NOs:141, 155, and 174, respectively.

4B1

In some embodiments, an anti-BACE1 antibody comprises a heavy chain CDR1 sequence comprising the amino acid sequence of SEQ ID NO:45, a heavy chain CDR2 sequence comprising the amino acid sequence of SEQ ID NO:69, and a heavy chain CDR3 sequence comprising the amino acid sequence of SEQ ID NO:96. In some embodiments, an anti-BACE1 antibody comprises a light chain CDR1 sequence comprising the amino acid sequence of SEQ ID NO:142, a light chain CDR2 sequence comprising the amino acid sequence of SEQ ID NO:156, and a light chain CDR3 sequence comprising the amino acid sequence of SEQ ID NO:175. In some embodiments, an anti-BACE1 antibody comprises a heavy chain CDR1-3 and a light chain CDR1-3 comprising the amino acid sequences of SEQ ID NOs:45, 69, 96, 142, 156, and 175, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:19. In some embodiments, an anti-BACE1 antibody comprises a heavy chain variable region comprising the amino acid sequence of SEQ ID NO:19.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:119. In some embodiments, an anti-BACE1 antibody comprises a light chain variable region comprising the amino acid sequence of SEQ ID NO:119.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:19 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:119. In some embodiments, an anti-BACE1 antibody comprises a heavy chain variable region comprising the amino acid sequence of SEQ ID NO:19 and further comprises a light chain variable region comprising the amino acid sequence of SEQ ID NO:119.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:45, 69, 96, 142, 156, and 175, respectively, or an antibody comprising a heavy chain variable region comprising the amino acid sequence of SEQ ID NO:19 and further comprising a light chain variable region comprising the amino acid sequence of SEQ ID NO:119).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:19 and (ii) a CDR-H1, CDR-H2, and CDR-H3 that is identical to SEQ ID NOs:45, 69, and 96, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:119 and (ii) a CDR-L1, CDR-L2, and CDR-L3 that is identical to SEQ ID NOs:142, 156, and 175, respectively.

1F8

In some embodiments, an anti-BACE1 antibody comprises a heavy chain CDR1 sequence comprising the amino acid sequence of SEQ ID NO:45, a heavy chain CDR2 sequence comprising the amino acid sequence of SEQ ID NO:70, and a heavy chain CDR3 sequence comprising the amino acid sequence of SEQ ID NO:97. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:168. In some embodiments, an anti-BACE1 antibody comprises a heavy chain CDR1-3 and a light chain CDR1-3 comprising the amino acid sequences of SEQ ID NOs:45, 70, 97, 138, 152, and 168, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:20. In some embodiments, an anti-BACE1 antibody comprises a heavy chain variable region comprising the amino acid sequence of SEQ ID NO:20.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:120. In some embodiments, an anti-BACE1 antibody comprises a light chain variable region comprising the amino acid sequence of SEQ ID NO:120.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:20 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:120. In some embodiments, an anti-BACE1 antibody comprises a heavy chain variable region comprising the amino acid sequence of SEQ ID NO:20 and further comprises a light chain variable region comprising the amino acid sequence of SEQ ID NO:120.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:45, 70, 97, 138, 152, and 168, respectively, or an antibody comprising a heavy chain variable region comprising the amino acid sequence of SEQ ID NO:20 and further comprising a light chain variable region comprising the amino acid sequence of SEQ ID NO:120).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:20 and (ii) a CDR-H1, CDR-H2, and CDR-H3 that is identical to SEQ ID NOs:45, 70, and 97, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:120 and (ii) a CDR-L1, CDR-L2, and CDR-L3 that is identical to SEQ ID NOs:138, 152, and 168, respectively.

2B8

In some embodiments, an anti-BACE1 antibody comprises a heavy chain CDR1 sequence comprising the amino acid sequence of SEQ ID NO:46, a heavy chain CDR2 sequence comprising the amino acid sequence of SEQ ID NO:71, and a heavy chain CDR3 sequence comprising the amino acid sequence of SEQ ID NO:98. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:176. In some embodiments, an anti-BACE1 antibody comprises a heavy chain CDR1-3 and a light chain CDR1-3 comprising the amino acid sequences of SEQ ID NOs:46, 71, 98, 138, 152, and 176, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:21. In some embodiments, an anti-BACE1 antibody comprises a heavy chain variable region comprising the amino acid sequence of SEQ ID NO:21.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:121. In some embodiments, an anti-BACE1 antibody comprises a light chain variable region comprising the amino acid sequence of SEQ ID NO:121.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:21 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:121. In some embodiments, an anti-BACE1 antibody comprises a heavy chain variable region comprising the amino acid sequence of SEQ ID NO:21 and further comprises a light chain variable region comprising the amino acid sequence of SEQ ID NO:121.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:46, 71, 98, 138, 152, and 176, respectively, or an antibody comprising a heavy chain variable region comprising the amino acid sequence of SEQ ID NO:21 and further comprising a light chain variable region comprising the amino acid sequence of SEQ ID NO:121).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:21 and (ii) a CDR-H1, CDR-H2, and CDR-H3 that is identical to SEQ ID NOs:46, 71, and 98, respectively; and/o (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:121 and (ii) a CDR-L1, CDR-L2, and CDR-L3 that is identical to SEQ ID NOs:138, 152, and 176, respectively.

1E7

In some embodiments, an anti-BACE1 antibody comprises a heavy chain CDR1 sequence comprising the amino acid sequence of SEQ ID NO:45, a heavy chain CDR2 sequence comprising the amino acid sequence of SEQ ID NO:71, and a heavy chain CDR3 sequence comprising the amino acid sequence of SEQ ID NO:98. In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:170. In some embodiments, an anti-BACE1 antibody comprises a heavy chain CDR1-3 and a light chain CDR1-3 comprising the amino acid sequences of SEQ ID NOs:45, 71, 98, 138, 152, and 170, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:22. In some embodiments, an anti-BACE1 antibody comprises a heavy chain variable region comprising the amino acid sequence of SEQ ID NO:22.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:114. In some embodiments, an anti-BACE1 antibody comprises a light chain variable region comprising the amino acid sequence of SEQ ID NO:114.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:22 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:114. In some embodiments, an anti-BACE1 antibody comprises a heavy chain variable region comprising the amino acid sequence of SEQ ID NO:22 and further comprises a light chain variable region comprising the amino acid sequence of SEQ ID NO:114.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:45, 71, 98, 138, 152, and 170, respectively, or an antibody comprising a heavy chain variable region comprising the amino acid sequence of SEQ ID NO:22 and further comprising a light chain variable region comprising the amino acid sequence of SEQ ID NO:114).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:22 and (ii) a CDR-H1, CDR-H2, and CDR-H3 that is identical to SEQ ID NOs:45, 71, and 98, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:114 and (ii) a CDR-L1, CDR-L2, and CDR-L3 that is identical to SEQ ID NOs:138, 152, and 170, respectively.

2H8 and Variants Thereof

In some embodiments, an anti-BACE1 antibody comprises a heavy chain CDR1 sequence comprising the amino acid sequence of any one of SEQ ID NOs:47-50, 409-414, and 433-434, a heavy chain CDR2 sequence comprising the amino acid sequence of any one of SEQ ID NOs:72-77, 415-422, and 435-436, and a heavy chain CDR3 sequence comprising the amino acid sequence of any one of SEQ ID NOs:99-100 and 423-429. In some embodiments, an anti-BACE1 antibody comprises a light chain CDR1 sequence comprising the amino acid sequence of any one of SEQ ID NOs:130, 138, 143, 144, and 393-394, a light chain CDR2 sequence comprising the amino acid sequence of any one of SEQ ID NOs:146, 152, 157, 395-402, and 430-431, and a light chain CDR3 sequence comprising the amino acid sequence of any one of SEQ ID NOs:159, 167, 177, 403-408, and 432.

In some embodiments, an anti-BACE1 antibody comprises a heavy chain CDR1 sequence comprising the amino acid sequence of any one of SEQ ID NOs:47-50, 409-414, and 433-434, a heavy chain CDR2 sequence comprising the amino acid sequence of any one of SEQ ID NOs:72-77, 415-422, and 435-436, a heavy chain CDR3 sequence comprising the amino acid sequence of any one of SEQ ID NOs:99-100 and 423-429, a light chain CDR1 sequence comprising the amino acid sequence of any one of SEQ ID NOs:130, 138, 143, 144, and 393-394, a light chain CDR2 sequence comprising the amino acid sequence of any one of SEQ ID NOs:146, 152, 157, 395-402, and 430-431, and a light chain CDR3 sequence comprising the amino acid sequence of any one of SEQ ID NOs:159, 167, 177, 403-408, and 432.

In some embodiments, an anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:99. In some embodiments, an anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:159. In some embodiments, an anti-BACE1 antibody comprises a heavy chain CDR1-3 and a light chain CDR1-3 comprising the amino acid sequences of SEQ ID NO:47, 72, 99, 143, 146, and 159, respectively.

In some embodiments, an anti-BACE1 antibody comprises a heavy chain CDR1 sequence comprising the amino acid sequence of SEQ ID NO:50, a heavy chain CDR2 sequence comprising the amino acid sequence of SEQ ID NO:77, and a heavy chain CDR3 sequence comprising the amino acid sequence of SEQ ID NO:100. In some embodiments, an anti-BACE1 antibody comprises a light chain CDR1 sequence comprising the amino acid sequence of SEQ ID NO:144, a light chain CDR2 sequence comprising the amino acid sequence of SEQ ID NO:146, and a light chain CDR3 sequence comprising the amino acid sequence of SEQ ID NO:159. In some embodiments, an anti-BACE1 antibody comprises a heavy chain CDR1-3 and a light chain CDR1-3 comprising the amino acid sequences of SEQ ID NO:50, 77, 100, 144, 146, and 159, respectively.

In some embodiments, an anti-BACE1 antibody comprises a heavy chain CDR1 sequence comprising the amino acid sequence of SEQ ID NO:48, a heavy chain CDR2 sequence comprising the amino acid sequence of SEQ ID NO:73, and a heavy chain CDR3 sequence comprising the amino acid sequence of SEQ ID NO:99.

In some embodiments, an anti-BACE1 antibody comprises a heavy chain CDR1 sequence comprising the amino acid sequence of SEQ ID NOs:49, a heavy chain CDR2 sequence comprising the amino acid sequence of SEQ ID NOs:74, and a heavy chain CDR3 sequence comprising the amino acid sequence of SEQ ID NOs:99.

In some embodiments, an anti-BACE1 antibody comprises a heavy chain CDR1 sequence comprising the amino acid sequence of SEQ ID NO:48, a heavy chain CDR2 sequence comprising the amino acid sequence of SEQ ID NO:75, and a heavy chain CDR3 sequence comprising the amino acid sequence of SEQ ID NO:99.

In some embodiments, an anti-BACE1 antibody comprises a heavy chain CDR1 sequence comprising the amino acid sequence of SEQ ID NO:48, a heavy chain CDR2 sequence comprising the amino acid sequence of SEQ ID NO:76, and a heavy chain CDR3 sequence comprising the amino acid sequence of SEQ ID NO:99.

In some embodiments, an anti-BACE1 antibody comprises a heavy chain CDR1 sequence comprising the amino acid sequence of SEQ ID NO:50, a heavy chain CDR2 sequence comprising the amino acid sequence of SEQ ID NO:77, and a heavy chain CDR3 sequence comprising the amino acid sequence of SEQ ID NO:100.

In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:146, and a light chain CDR3 sequence comprising the amino acid sequence of SEQ ID NO:177.

In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:157, and a light chain CDR3 sequence comprising the amino acid sequence of SEQ ID NO:159.

In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:152, and a light chain CDR3 sequence comprising the amino acid sequence of SEQ ID NO:159.

In some embodiments, an anti-BACE1 antibody comprises a light chain CDR1 sequence comprising the amino acid sequence of SEQ ID NO:138, a light chain CDR2 sequence comprising the amino acid sequence of SEQ ID NO:146, and a light chain CDR3 sequence comprising the amino acid sequence of SEQ ID NO:159.

In some embodiments, an anti-BACE1 antibody comprises a light chain CDR1 sequence comprising the amino acid sequence of SEQ ID NO:130, a light chain CDR2 sequence comprising the amino acid sequence of SEQ ID NO:146, and a light chain CDR3 sequence comprising the amino acid sequence of SEQ ID NO:159.

In some embodiments, an anti-BACE1 antibody comprises a light chain CDR1 sequence comprising the amino acid sequence of SEQ ID NO:144, a light chain CDR2 sequence comprising the amino acid sequence of SEQ ID NO:146, and a light chain CDR3 sequence comprising the amino acid sequence of SEQ ID NO:159.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:23-28. In some embodiments, an anti-BACE1 antibody comprises a heavy chain variable region comprising the amino acid sequence of any one of SEQ ID NOs:23-28.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:122-128. In some embodiments, an anti-BACE1 antibody comprises a light chain variable region comprising the amino acid sequence of any one of SEQ ID NOs:122-128.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:23-28 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:122-128. In some embodiments, an anti-BACE1 antibody comprises a heavy chain variable region comprising the amino acid sequence of any one of SEQ ID NOs:23-28 and further comprises a light chain variable region comprising the amino acid sequence of any one of SEQ ID NOs:122-128.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:23. In some embodiments, an anti-BACE1 antibody comprises a heavy chain variable region comprising the amino acid sequence of SEQ ID NO:23.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:24. In some embodiments, an anti-BACE1 antibody comprises a heavy chain variable region comprising the amino acid sequence of SEQ ID NO:24.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:25. In some embodiments, an anti-BACE1 antibody comprises a heavy chain variable region comprising the amino acid sequence of SEQ ID NO:25.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:26. In some embodiments, an anti-BACE1 antibody comprises a heavy chain variable region comprising the amino acid sequence of SEQ ID NO:26.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:27. In some embodiments, an anti-BACE1 antibody comprises a heavy chain variable region comprising the amino acid sequence of SEQ ID NO:27.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:28. In some embodiments, an anti-BACE1 antibody comprises a heavy chain variable region comprising the amino acid sequence of SEQ ID NO:28.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:122. In some embodiments, an anti-BACE1 antibody comprises a light chain variable region comprising the amino acid sequence of SEQ ID NO:122.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:123. In some embodiments, an anti-BACE1 antibody comprises a light chain variable region comprising the amino acid sequence of SEQ ID NO:123.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:124. In some embodiments, an anti-BACE1 antibody comprises a light chain variable region comprising the amino acid sequence of SEQ ID NO:124.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:125. In some embodiments, an anti-BACE1 antibody comprises a light chain variable region comprising the amino acid sequence of SEQ ID NO:125.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:126. In some embodiments, an anti-BACE1 antibody comprises a light chain variable region comprising the amino acid sequence of SEQ ID NO:126.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:127. In some embodiments, an anti-BACE1 antibody comprises a light chain variable region comprising the amino acid sequence of SEQ ID NO:127.

In some embodiments, an anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:128. In some embodiments, an anti-BACE1 antibody comprises a light chain variable region comprising the amino acid sequence of SEQ ID NO:128.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:23 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:122. In some embodiments, an anti-BACE1 antibody comprises a heavy chain variable region comprising the amino acid sequence of SEQ ID NO:23 and further comprises a light chain variable region comprising the amino acid sequence of SEQ ID NO:122.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:47, 72, 99, 143, 146, and 159, respectively, or an antibody comprising a heavy chain variable region comprising the amino acid sequence of SEQ ID NO:23 and further comprising a light chain variable region comprising the amino acid sequence of SEQ ID NO:122).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:23 and (ii) a CDR-H1, CDR-H2, and CDR-H3 that is identical to SEQ ID NOs:47, 72, and 99, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:122 and (ii) a CDR-L1, CDR-L2, and CDR-L3 that is identical to SEQ ID NOs:143, 146, and 159, respectively.

In some embodiments, an anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:28 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:128. In some embodiments, an anti-BACE1 antibody comprises a heavy chain variable region comprising the amino acid sequence of SEQ ID NO:28 and further comprises a light chain variable region comprising the amino acid sequence of SEQ ID NO:128.

In some embodiments, an anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:50, 77, 100, 144, 146, and 159, respectively, or an antibody comprising a heavy chain variable region comprising the amino acid sequence of SEQ ID NO:28 and further comprising a light chain variable region comprising the amino acid sequence of SEQ ID NO:128).

In some embodiments, an anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:28 and (ii) a CDR-H1, CDR-H2, and CDR-H3 that is identical to SEQ ID NOs:50, 77, and 100, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:128 and (ii) a CDR-L1, CDR-L2, and CDR-L3 that is identical to SEQ ID NOs:144, 146, and 159, respectively.

In some embodiments, an anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:24 and (ii) a CDR-H1, CDR-H2, and CDR-H3 that is identical to SEQ ID NOs:48, 73, and 99, respectively.

In some embodiments, an anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:25 and (ii) a CDR-H1, CDR-H2, and CDR-H3 that is identical to SEQ ID NOs:49, 74, and 99, respectively.

In some embodiments, an anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:26 and (ii) a CDR-H1, CDR-H2, and CDR-H3 that is identical to SEQ ID NOs:48, 75, and 99, respectively.

In some embodiments, an anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:27 and (ii) a CDR-H1, CDR-H2, and CDR-H3 that is identical to SEQ ID NOs:48, 76, and 99, respectively.

In some embodiments, an anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:28 and (ii) a CDR-H1, CDR-H2, and CDR-H3 that is identical to SEQ ID NOs:50, 77, and 100, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:123 and (ii) a CDR-L1, CDR-L2, and CDR-L3 that is identical to SEQ ID NOs:138, 146, and 177, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:124 and (ii) a CDR-L1, CDR-L2, and CDR-L3 that is identical to SEQ ID NOs:138, 157, and 159, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:125 and (ii) a CDR-L1, CDR-L2, and CDR-L3 that is identical to SEQ ID NOs:138, 152, and 159, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:126 and (ii) a CDR-L1, CDR-L2, and CDR-L3 that is identical to SEQ ID NOs:138, 146, and 159, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:127 and (ii) a CDR-L1, CDR-L2, and CDR-L3 that is identical to SEQ ID NOs:130, 146, and 159, respectively.

In some embodiments, an anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:128 and (ii) a CDR-L1, CDR-L2, and CDR-L3 that is identical to SEQ ID NOs:144, 146, and 159, respectively.

IV. HUMANIZED BACE1 ANTIBODIES

In another aspect, humanized antibodies and antigen-binding portions of antibodies that specifically bind to a BACE1 protein are provided. In some embodiments, the humanized anti-BACE1 antibody specifically binds to a human BACE1 protein. In some embodiments, the humanized anti-BACE1 antibody is selective for BACE1 over other beta-secretase proteins (e.g., BACE2). In some embodiments, the humanized anti-BACE1 antibody inhibits BACE1 activity. In some embodiments, the humanized anti-BACE1 antibody reduces or inhibits the production and/or aggregation of amyloid-β peptides. In some embodiments, the humanized anti-BACE1 antibody prevents, reduces, or inhibits the formation of amyloid plaques.

A. Binding Characteristics of Humanized Anti-Bace1 Antibodies

In some embodiments, a humanized anti-BACE1 antibody binds to the ectodomain of BACE1. In some embodiments, the epitope is a linear epitope. In some embodiments, the epitope is a discontinuous or conformational epitope.

In some embodiments, a humanized anti-BACE1 antibody recognizes an epitope that is the same or substantially the same as the epitope recognized by an antibody clone as described herein. As used herein, the term "substantially the same," as used with reference to an epitope recognized by a reference antibody, means that the anti-BACE1 antibody recognizes an epitope that is identical, within, or nearly identical to (e.g., has at least 90% sequence identity to, or has one, two, or three amino acid substitutions, e.g., conservative substitutions, relative to), or has substantial overlap with (e.g., at least 50%, 60%, 70%, 80%, 90%, or 95% overlap with) the epitope recognized by the reference antibody (e.g., an antibody clone as described herein).

In some embodiments, the humanized anti-BACE1 antibody recognizes an epitope that is the same or substantially the same as the epitope recognized by an antibody clone selected from the group consisting of hu2H8v1, hu2H8v2, hu2H8v3, hu2H8v4, hu2H8v5, hu2H8v6, hu2H8v7, hu2H8v8, hu2H8v9, hu2H8v10, hu2H8v11, hu2H8v12, hu2H8v13, hu2H8v14, hu2H8v15, hu2H8v16, hu2H8v17, hu2H8v18, hu2H8v19, hu2H8v20, hu2H8v21, hu2H8v22, hu2H8v23, hu2H8v24, hu2H8v25, hu2H8v26, hu2H8v27, hu2H8v28, hu2H8v29, and hu2H8v30. In some embodiments, the humanized anti-BACE1 antibody recognizes an epitope that is identical to the epitope recognized by an antibody clone selected from the group consisting of hu2H8v1, hu2H8v2, hu2H8v3, hu2H8v4, hu2H8v5, hu2H8v6, hu2H8v7, hu2H8v8, hu2H8v9, hu2H8v10, hu2H8v11, hu2H8v12, hu2H8v13, hu2H8v14, hu2H8v15, hu2H8v16, hu2H8v17, hu2H8v18, hu2H8v19, hu2H8v20, hu2H8v21, hu2H8v22, hu2H8v23, hu2H8v24, hu2H8v25, hu2H8v26, hu2H8v27, hu2H8v28, hu2H8v29, and hu2H8v30.

In some embodiments, the humanized anti-BACE1 antibody recognizes an epitope that is the same or substantially the same as the epitope recognized by an antibody clone selected from the group consisting of hu2H8v29.1, hu2H8v29.2, hu2H8v29.3, hu2H8v29.4, hu2H8v29.5, hu2H8v29.6, hu2H8v29.7, hu2H8v29.8, hu2H8v29.9, hu2H8v29.10, hu2H8v29.11, hu2H8v29.12, hu2H8v29.13, hu2H8v29.14, hu2H8v29.15, hu2H8v29.16, hu2H8v29.17, hu2H8v29.18, hu2H8v29.19, hu2H8v29.20, hu2H8v29.21, hu2H8v29.22, hu2H8v29.23, hu2H8v29.24, hu2H8v29.25, hu2H8v29.26, hu2H8v29.27, and hu2H8v29.28. In some embodiments, the humanized anti-BACE1 antibody recognizes an epitope that is identical to the epitope recognized by an antibody clone selected from the group consisting of hu2H8v29.1, hu2H8v29.2, hu2H8v29.3, hu2H8v29.4, hu2H8v29.5, hu2H8v29.6, hu2H8v29.7, hu2H8v29.8, hu2H8v29.9, hu2H8v29.10, hu2H8v29.11, hu2H8v29.12, hu2H8v29.13, hu2H8v29.14, hu2H8v29.15, hu2H8v29.16, hu2H8v29.17, hu2H8v29.18, hu2H8v29.19, hu2H8v29.20, hu2H8v29.21, hu2H8v29.22, hu2H8v29.23, hu2H8v29.24, hu2H8v29.25, hu2H8v29.26, hu2H8v29.27, and hu2H8v29.28.

In some embodiments, a humanized antibody that specifically binds to human BACE1 protein exhibits cross-reactivity with one or more other BACE1 proteins of another species. In some embodiments, a humanized anti-BACE1 antibody that specifically binds to human BACE1 exhibits cross-reactivity with a cynomolgus monkey ("cyno") BACE1 protein. In some embodiments, a humanized anti-BACE1 antibody that specifically binds to human BACE1 exhibits cross-reactivity with a mouse BACE1 protein. In some embodiments, a humanized anti-BACE1 antibody that specifically binds to human BACE1 exhibits cross-reactivity with a rat BACE1 protein. In some embodiments, an antibody that specifically binds to human BACE1 protein exhibits cross-reactivity with one, two, or all three of mouse BACE1, cyno BACE1, and rat BACE1. In some embodiments, a humanized anti-BACE1 antibody exhibits cross-reactivity with human BACE1, cyno BACE1, and mouse BACE1. Methods for analyzing binding affinity, binding kinetics, and cross-reactivity are known in the art.

B. Humanized Anti-Bace1 Antibody Sequences

In some embodiments, a humanized antibody or antigen-binding portion thereof that specifically binds to a human BACE1 protein comprises a light chain sequence, or a portion thereof, and/or a heavy chain sequence, or a portion thereof, derived from any of the following antibodies described herein: Clone hu2H8v1, Clone hu2H8v2, Clone hu2H8v3, Clone hu2H8v4, Clone hu2H8v5, Clone hu2H8v6, Clone hu2H8v7, Clone hu2H8v8, Clone hu2H8v9, Clone hu2H8v10, Clone hu2H8v11, Clone hu2H8v12, Clone hu2H8v13, Clone hu2H8v14, Clone hu2H8v15, Clone hu2H8v16, Clone hu2H8v17, Clone hu2H8v18, Clone hu2H8v19, Clone hu2H8v20, Clone hu2H8v21, Clone hu2H8v22, Clone hu2H8v23, Clone hu2H8v24, Clone hu2H8v25, Clone hu2H8v26, Clone hu2H8v27, Clone hu2H8v28, Clone hu2H8v29, or Clone hu2H8v30. The amino acid sequences of the light chain variable region (VL) and heavy chain variable region (VH) of the humanized anti-BACE1 antibodies Clone hu2H8v1, Clone hu2H8v2, Clone hu2H8v3, Clone hu2H8v4, Clone hu2H8v5, Clone hu2H8v6, Clone hu2H8v7, Clone hu2H8v8, Clone hu2H8v9, Clone hu2H8v10, Clone hu2H8v11, Clone hu2H8v12, Clone hu2H8v13, Clone hu2H8v14, Clone hu2H8v15, Clone hu2H8v16, Clone hu2H8v17, Clone hu2H8v18, Clone hu2H8v19, Clone hu2H8v20, Clone hu2H8v21, Clone hu2H8v22, Clone hu2H8v23, Clone hu2H8v24, Clone hu2H8v25, Clone hu2H8v26, Clone hu2H8v27, Clone hu2H8v28, Clone hu2H8v29, and Clone hu2H8v30 are set forth in Tables 6 and 12 below.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:310 and (ii) a CDR-H1, CDR-H2, and CDR-H3 that is identical to SEQ ID NOs:47, 72, and 99, respectively.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:311 and (ii) a CDR-H1, CDR-H2, and CDR-H3 that is identical to SEQ ID NOs:47, 72, and 99, respectively.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:312 and (ii) a CDR-H1, CDR-H2, and CDR-H3 that is identical to SEQ ID NOs:47, 72, and 99, respectively.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:313 and (ii) a CDR-H1, CDR-H2, and CDR-H3 that is identical to SEQ ID NOs:47, 72, and 99, respectively.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:314 and (ii) a CDR-H1, CDR-H2, and CDR-H3 that is identical to SEQ ID NOs:47, 72, and 99, respectively.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:315 and (ii) a CDR-H1, CDR-H2, and CDR-H3 that is identical to SEQ ID NOs:47, 72, and 99, respectively.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:316 and (ii) a CDR-L1, CDR-L2, and CDR-L3 that is identical to SEQ ID NOs:143, 146, and 159, respectively.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:317 and (ii) a CDR-L1, CDR-L2, and CDR-L3 that is identical to SEQ ID NOs:143, 146, and 159, respectively.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:318 and (ii) a CDR-L1, CDR-L2, and CDR-L3 that is identical to SEQ ID NOs:143, 146, and 159, respectively.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:319 and (ii) a CDR-L1, CDR-L2, and CDR-L3 that is identical to SEQ ID NOs:143, 146, and 159, respectively.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:320 and (ii) a CDR-L1, CDR-L2, and CDR-L3 that is identical to SEQ ID NOs:143, 146, and 159, respectively.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 310-315. In some embodiments, a humanized anti-BACE1 antibody comprises a heavy chain variable region comprising the amino acid sequence of any one of SEQ ID NOs: 310-315. In some embodiments, a heavy chain variable region sequence having at least 90% sequence identity to a reference sequence (e.g., any one of SEQ ID NOs:310-315) contains one, two, three, four, five, six, seven, eight, nine, ten or more substitutions (e.g., conservative substitutions), insertions, or deletions relative to the reference sequence but retains the ability to specifically bind to a human BACE1 protein. In some embodiments, a heavy chain variable region contains one, two, or three substitutions (e.g., conservative substitutions) in any one of SEQ ID NOs:310-315.

In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 316-320. In some embodiments, a humanized anti-BACE1 antibody comprises a light chain variable region comprising the amino acid sequence of any one of SEQ ID NOs:316-320. In some embodiments, a light chain variable region sequence having at least 90% sequence identity to a reference sequence (e.g., any one of SEQ ID NOs:316-320) contains one, two, three, four, five, six, seven, eight, nine, ten or more substitutions (e.g., conservative substitutions), insertions, or deletions relative to the reference sequence but retains the ability to specifically bind to a human BACE1 protein. In some embodiments, a light chain variable region contains one, two, or three substitutions (e.g., conservative substitutions) in any one of SEQ ID NOs:316-320.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 310-315, and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:316-320. In some embodiments, a humanized anti-BACE1 antibody comprises a heavy chain variable region comprising the amino acid sequence of any one of SEQ ID NOs:310-315 and further comprises a light chain variable region comprising the amino acid sequence of any one of SEQ ID NOs:316-320.

In some embodiments, a humanized antibody or antigen-binding portion thereof that specifically binds to a human BACE1 protein comprises a light chain sequence, or a portion thereof, and/or a heavy chain sequence, or a portion thereof, derived from any of the following antibodies described herein: Clone hu2H8v29.1, Clone hu2H8v29.2, Clone hu2H8v29.3, Clone hu2H8v29.4, Clone hu2H8v29.5, Clone hu2H8v29.6, Clone hu2H8v29.7, Clone hu2H8v29.8, Clone hu2H8v29.9, Clone hu2H8v29.10, Clone hu2H8v29.11, Clone hu2H8v29.12, Clone hu2H8v29.13, Clone hu2H8v29.14, Clone hu2H8v29.15, Clone hu2H8v29.16, Clone hu2H8v29.17, Clone hu2H8v29.18, Clone hu2H8v29.19, Clone hu2H8v29.20, Clone hu2H8v29.21, Clone hu2H8v29.22, Clone hu2H8v29.23, Clone hu2H8v29.24, Clone hu2H8v29.25, Clone hu2H8v29.26, Clone hu2H8v29.27, or Clone hu2H8v29.28. The amino acid sequences of the light chain variable region (VL) and heavy chain variable region (VH) of the humanized anti-BACE1 antibodies Clone hu2H8v29.1, Clone hu2H8v29.2, Clone hu2H8v29.3, Clone hu2H8v29.4, Clone hu2H8v29.5, Clone hu2H8v29.6, Clone hu2H8v29.7, Clone hu2H8v29.8, Clone hu2H8v29.9, Clone hu2H8v29.10, Clone hu2H8v29.11, Clone hu2H8v29.12, Clone hu2H8v29.13, Clone hu2H8v29.14, Clone hu2H8v29.15, Clone hu2H8v29.16, Clone hu2H8v29.17, Clone hu2H8v29.18, Clone hu2H8v29.19, Clone hu2H8v29.20, Clone hu2H8v29.21, Clone hu2H8v29.22, Clone hu2H8v29.23, Clone hu2H8v29.24, Clone hu2H8v29.25, Clone hu2H8v29.26, Clone hu2H8v29.27, and Clone hu2H8v29.28 are set forth in Tables 10-12 below.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:416, and a heavy chain CDR3 sequence comprising the amino acid sequence of SEQ ID NO:425. In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:420, and a heavy chain CDR3 sequence comprising the amino acid sequence of SEQ ID NO:425. In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:395, and a light chain CDR3 sequence comprising the amino acid sequence of SEQ ID NO:405. In some embodiments, a humanized anti-BACE1 antibody comprises a heavy chain CDR1-3 and a light chain CDR1-3 comprising the amino acid sequences of SEQ ID NO:47, 416, 425, 143, 395, and 405, respectively. In some embodiments, a humanized anti-BACE1 antibody comprises a heavy chain CDR1-3 and a light chain CDR1-3 comprising the amino acid sequences of SEQ ID NO:47, 420, 425, 143, 395, and 405, respectively.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:464 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a heavy chain variable region comprising the amino acid sequence of SEQ ID NO:464 and further comprises a light chain variable region comprising the amino acid sequence of SEQ ID NO:463.

In some embodiments, a humanized anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:47, 416, 425, 143, 395, and 405, respectively, or an antibody comprising a heavy chain variable region comprising the amino acid sequence of SEQ ID NO:464 and further comprising a light chain variable region comprising the amino acid sequence of SEQ ID NO:463).

In some embodiments, a humanized anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:464 and (ii) a CDR-H1, CDR-H2, and CDR-H3 that is identical to SEQ ID NOs:47, 416, and 425, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:463 and (ii) a CDR-L1, CDR-L2, and CDR-L3 that is identical to SEQ ID NOs:143, 395, and 405, respectively.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:465 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a heavy chain variable region comprising the amino acid sequence of SEQ ID NO:465 and further comprises a light chain variable region comprising the amino acid sequence of SEQ ID NO:463.

In some embodiments, a humanized anti-BACE1 antibody is an antibody that competes for binding with an antibody as described herein (e.g., an antibody comprising a heavy chain CDR1-3 and a light chain CDR1-3 comprising the amino acid sequences of SEQ ID NOs:47, 420, 425, 143, 395, and 405, respectively, or an antibody comprising a heavy chain variable region comprising the amino acid sequence of SEQ ID NO:465 and further comprising a light chain variable region comprising the amino acid sequence of SEQ ID NO:463).

In some embodiments, a humanized anti-BACE1 antibody comprises: (a) a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:465 and (ii) a CDR-H1, CDR-H2, and CDR-H3 that is identical to SEQ ID NOs:47, 420, and 425, respectively; and/or (b) a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:463 and (ii) a CDR-L1, CDR-L2, and CDR-L3 that is identical to SEQ ID NOs:143, 395, and 405, respectively.

In some embodiments, a humanized anti-BACE1 antibody comprises a heavy chain CDR1 sequence comprising the amino acid sequence of SEQ ID NO:409, a heavy chain CDR2 sequence comprising the amino acid sequence of SEQ ID NO:72, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:448 and (ii) a CDR-H1, CDR-H2, and CDR-H3 that is identical to SEQ ID NOs:409, 72, and 99, respectively.

In some embodiments, a humanized anti-BACE1 antibody comprises a heavy chain CDR1 sequence comprising the amino acid sequence of SEQ ID NO:410, a heavy chain CDR2 sequence comprising the amino acid sequence of SEQ ID NO:72, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:449 and (ii) a CDR-H1, CDR-H2, and CDR-H3 that is identical to SEQ ID NOs:410, 72, and 99, respectively.

In some embodiments, a humanized anti-BACE1 antibody comprises a heavy chain CDR1 sequence comprising the amino acid sequence of SEQ ID NO:411, a heavy chain CDR2 sequence comprising the amino acid sequence of SEQ ID NO:72, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:450 and (ii) a CDR-H1, CDR-H2, and CDR-H3 that is identical to SEQ ID NOs:411, 72, and 99, respectively.

In some embodiments, a humanized anti-BACE1 antibody comprises a heavy chain CDR1 sequence comprising the amino acid sequence of SEQ ID NO:412, a heavy chain CDR2 sequence comprising the amino acid sequence of SEQ ID NO:72, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:451 and (ii) a CDR-H1, CDR-H2, and CDR-H3 that is identical to SEQ ID NOs:412, 72, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:415, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:452 and (ii) a CDR-H1, CDR-H2, and CDR-H3 that is identical to SEQ ID NOs:47, 415, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:416, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:453 and (ii) a CDR-H1, CDR-H2, and CDR-H3 that is identical to SEQ ID NOs:47, 416, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:417, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:454 and (ii) a CDR-H1, CDR-H2, and CDR-H3 that is identical to SEQ ID NOs:47, 417, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:418, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:455 and (ii) a CDR-H1, CDR-H2, and CDR-H3 that is identical to SEQ ID NOs:47, 418, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:419, and a heavy chain CDR3 sequence comprising the amino acid sequence of SEQ ID NO:99.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:456 and (ii) a CDR-H1, CDR-H2, and CDR-H3 that is identical to SEQ ID NOs:47, 419, and 99, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:100.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:457 and (ii) a CDR-H1, CDR-H2, and CDR-H3 that is identical to SEQ ID NOs:47, 72, and 100, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:423.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:458 and (ii) a CDR-H1, CDR-H2, and CDR-H3 that is identical to SEQ ID NOs:47, 72, and 423, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:424.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:459 and (ii) a CDR-H1, CDR-H2, and CDR-H3 that is identical to SEQ ID NOs:47, 72, and 424, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:425.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:460 and (ii) a CDR-H1, CDR-H2, and CDR-H3 that is identical to SEQ ID NOs:47, 72, and 425, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:426.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:461 and (ii) a CDR-H1, CDR-H2, and CDR-H3 that is identical to SEQ ID NOs:47, 72, and 426, respectively.

In some embodiments, a humanized anti-BACE1 antibody comprises a heavy chain CDR1 sequence comprising the amino acid sequence of SEQ ID NO:47, a heavy chain CDR2 sequence comprising the amino acid sequence of SEQ ID NO:72, and a heavy chain CDR3 sequence comprising the amino acid sequence of SEQ ID NO:427.

In some embodiments, a humanized anti-BACE1 antibody comprises a heavy chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:462 and (ii) a CDR-H1, CDR-H2, and CDR-H3 that is identical to SEQ ID NOs:47, 72, and 427, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:395, and a light chain CDR3 sequence comprising the amino acid sequence of SEQ ID NO:159.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:437 and (ii) a CDR-L1, CDR-L2, and CDR-L3 that is identical to SEQ ID NOs:143, 395, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:396, and a light chain CDR3 sequence comprising the amino acid sequence of SEQ ID NO:159.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:438 and (ii) a CDR-L1, CDR-L2, and CDR-L3 that is identical to SEQ ID NOs:143, 396, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:397, and a light chain CDR3 sequence comprising the amino acid sequence of SEQ ID NO:159.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:439 and (ii) a CDR-L1, CDR-L2, and CDR-L3 that is identical to SEQ ID NOs:143, 397, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:398, and a light chain CDR3 sequence comprising the amino acid sequence of SEQ ID NO:159.

In some embodiments, a humanized anti-BACE1 antibody comprises a light chain variable region comprising (i)

at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:440 and (ii) a CDR-L1, CDR-L2, and CDR-L3 that is identical to SEQ ID NOs:143, 398, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:399, and a light chain CDR3 sequence comprising the amino acid sequence of SEQ ID NO:159.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:441 and (ii) a CDR-L1, CDR-L2, and CDR-L3 that is identical to SEQ ID NOs:143, 399, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:400, and a light chain CDR3 sequence comprising the amino acid sequence of SEQ ID NO:159.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:442 and (ii) a CDR-L1, CDR-L2, and CDR-L3 that is identical to SEQ ID NOs:143, 400, and 159, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:167.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:443 and (ii) a CDR-L1, CDR-L2, and CDR-L3 that is identical to SEQ ID NOs:143, 146, and 167, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:403.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:444 and (ii) a CDR-L1, CDR-L2, and CDR-L3 that is identical to SEQ ID NOs:143, 146, and 403, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:404.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:445 and (ii) a CDR-L1, CDR-L2, and CDR-L3 that is identical to SEQ ID NOs:143, 146, and 404, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:405.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:446 and (ii) a CDR-L1, CDR-L2, and CDR-L3 that is identical to SEQ ID NOs:143, 146, and 405, respectively.

In some embodiments, a humanized anti-BACE1 antibody comprises a light chain CDR1 sequence comprising the amino acid sequence of SEQ ID NO:143, a light chain CDR2 sequence comprising the amino acid sequence of SEQ ID NO:146, and a light chain CDR3 sequence comprising the amino acid sequence of SEQ ID NO:406.

In some embodiments, a humanized anti-BACE1 antibody comprises a light chain variable region comprising (i) at least 75% sequence identity (e.g., at least 80%, at least 85%, at least 90%, at least 91%, at least 92%, at least 93%, at least 94%, at least 95%, at least 96%, at least 97%, at least 98%, or at least 99% sequence identity) to SEQ ID NO:447 and (ii) a CDR-L1, CDR-L2, and CDR-L3 that is identical to SEQ ID NOs:143, 146, and 406, respectively.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 448-462 and 464-465. In some embodiments, a humanized anti-BACE1 antibody comprises a heavy chain variable region comprising the amino acid sequence of any one of SEQ ID NOs:448-462 and 464-465. In some embodiments, a heavy chain variable region sequence having at least 90% sequence identity to a reference sequence (e.g., any one of SEQ ID NOs:448-462 and 464-465) contains one, two, three, four, five, six, seven, eight, nine, ten or more substitutions (e.g., conservative substitutions), insertions, or deletions relative to the reference sequence but retains the ability to specifically bind to a human BACE1 protein. In some embodiments, a heavy chain variable region contains one, two, or three substitutions (e.g., conservative substitutions) in any one of SEQ ID NOs:448-462 and 464-465.

In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 437-447 and 463. In some embodiments, a humanized anti-BACE1 antibody comprises a light chain variable region comprising the amino acid sequence of any one of SEQ ID NOs:437-447 and 463. In some embodiments, a light chain variable region sequence having at least 90% sequence identity to a reference sequence (e.g., any one of SEQ ID NOs:437-447 and 463) contains one, two, three, four, five, six, seven, eight, nine, ten or more substitutions (e.g., conservative substitutions), insertions, or deletions relative to the reference sequence but retains the ability to specifically bind to a human BACE1 protein. In some embodiments, a light chain variable region contains one, two, or three substitutions (e.g., conservative substitutions) in any one of SEQ ID NOs:437-447 and 463.

In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs: 448-462 and 464-465, and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to any one of SEQ ID NOs:437-447 and 463. In some embodiments, a humanized anti-BACE1 antibody comprises a heavy chain variable region comprising the amino acid sequence of any one of SEQ ID NOs:448-462 and 464-465 and further comprises a light chain variable region comprising the amino acid sequence of any one of SEQ ID NOs:437-447 and 463.

Clone hu2H8v1: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310. In some embodiments, a humanized anti-BACE1 antibody comprises a heavy chain variable region comprising the amino acid sequence of SEQ ID NO:310. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:310 and further comprises a light chain variable region comprising the amino acid sequence of SEQ ID NO:316.

Clone hu2H8v2: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311. In some embodiments, a humanized anti-BACE1 antibody comprises a heavy chain variable region comprising the amino acid sequence of SEQ ID NO:311. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:311 and further comprises a light chain variable region comprising the amino acid sequence of SEQ ID NO:316.

Clone hu2H8v3: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312. In some embodiments, a humanized anti-BACE1 antibody comprises a heavy chain variable region comprising the amino acid sequence of SEQ ID NO:312. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:312 and further comprises a light chain variable region comprising the amino acid sequence of SEQ ID NO:316.

Clone hu2H8v4: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313. In some embodiments, a humanized anti-BACE1 antibody comprises a heavy chain variable region comprising the amino acid sequence of SEQ ID NO:313. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:313 and further comprises a light chain variable region comprising the amino acid sequence of SEQ ID NO:316.

Clone hu2H8v5: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:316.

Clone hu2H8v6: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315. In some embodiments, a humanized anti-BACE1 antibody comprises a heavy chain variable region comprising the amino acid sequence of SEQ ID NO:315. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a light chain variable region comprising the amino acid sequence of SEQ ID NO:316. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:316. In some embodiments, a humanized anti-BACE1 antibody comprises a heavy chain variable region comprising the amino acid sequence of SEQ ID NO:315 and further comprises a light chain variable region comprising the amino acid sequence of SEQ ID NO:316.

Clone hu2H8v7: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310. In some embodiments, a humanized anti-BACE1 antibody comprises a heavy chain variable region comprising the amino acid sequence of SEQ ID NO:310. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:310 and further comprises a light chain variable region comprising the amino acid sequence of SEQ ID NO:317.

Clone hu2H8v8: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311. In some embodiments, a humanized anti-BACE1 antibody comprises a heavy chain variable region comprising the amino acid sequence of SEQ ID NO:311. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:311 and further comprises a light chain variable region comprising the amino acid sequence of SEQ ID NO:317.

Clone hu2H8v9: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312. In some embodiments, a humanized anti-BACE1 antibody comprises a heavy chain variable region comprising the amino acid sequence of SEQ ID NO:312. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:312 and further comprises a light chain variable region comprising the amino acid sequence of SEQ ID NO:317.

Clone hu2H8v10: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313. In some embodiments, a humanized anti-BACE1 antibody comprises a heavy chain variable region comprising the amino acid sequence of SEQ ID NO:313. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:313 and further comprises a light chain variable region comprising the amino acid sequence of SEQ ID NO:317.

Clone hu2H8v11: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:317.

Clone hu2H8v12: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315. In some embodiments, a humanized anti-BACE1 antibody comprises a heavy chain variable region comprising the amino acid sequence of SEQ ID NO:315. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a light chain variable region comprising the amino acid sequence of SEQ ID NO:317. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:317. In some embodiments, a humanized anti-BACE1 antibody comprises a heavy chain variable region comprising the amino acid sequence of SEQ ID NO:315 and further comprises a light chain variable region comprising the amino acid sequence of SEQ ID NO:317.

Clone hu2H8v13: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310. In some embodiments, a humanized anti-BACE1 antibody comprises a heavy chain variable region comprising the amino acid sequence of SEQ ID NO:310. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:310 and further comprises a light chain variable region comprising the amino acid sequence of SEQ ID NO:318.

Clone hu2H8v14: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311. In some embodiments, a humanized anti-BACE1 antibody comprises a heavy chain variable region comprising the amino acid sequence of SEQ ID NO:311. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:311 and further comprises a light chain variable region comprising the amino acid sequence of SEQ ID NO:318.

Clone hu2H8v15: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312. In some embodiments, a humanized anti-BACE1 antibody comprises a heavy chain variable region comprising the amino acid sequence of SEQ ID NO:312. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:312 and further comprises a light chain variable region comprising the amino acid sequence of SEQ ID NO:318.

Clone hu2H8v16: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313. In some embodiments, a humanized anti-BACE1 antibody comprises a heavy chain variable region comprising the amino acid sequence of SEQ ID NO:313. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:313 and further comprises a light chain variable region comprising the amino acid sequence of SEQ ID NO:318.

Clone hu2H8v17: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:318.

Clone hu2H8v18: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315. In some embodiments, a humanized anti-BACE1 antibody comprises a heavy chain variable region comprising the amino acid sequence of SEQ ID NO:315. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a light chain variable region comprising the amino acid sequence of SEQ ID NO:318. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:318. In some embodiments, a humanized anti-BACE1 antibody comprises a heavy chain variable region comprising the amino acid sequence of SEQ ID NO:315 and further comprises a light chain variable region comprising the amino acid sequence of SEQ ID NO:318.

Clone hu2H8v19: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310. In some embodiments, a humanized anti-BACE1 antibody comprises a heavy chain variable region comprising the amino acid sequence of SEQ ID NO:310. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:310 and further comprises a light chain variable region comprising the amino acid sequence of SEQ ID NO:319.

Clone hu2H8v20: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311. In some embodiments, a humanized anti-BACE1 antibody comprises a heavy chain variable region comprising the amino acid sequence of SEQ ID NO:311. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:311 and further comprises a light chain variable region comprising the amino acid sequence of SEQ ID NO:319.

Clone hu2H8v21: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312. In some embodiments, a humanized anti-BACE1 antibody comprises a heavy chain variable region comprising the amino acid sequence of SEQ ID NO:312. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:312 and further comprises a light chain variable region comprising the amino acid sequence of SEQ ID NO:319.

Clone hu2H8v22: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313. In some embodiments, a humanized anti-BACE1 antibody comprises a heavy chain variable region comprising the amino acid sequence of SEQ ID NO:313. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:313 and further comprises a light chain variable region comprising the amino acid sequence of SEQ ID NO:319.

Clone hu2H8v23: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:319.

Clone hu2H8v24: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315. In some embodiments, a humanized anti-BACE1 antibody comprises a heavy chain variable region comprising the amino acid sequence of SEQ ID NO:315. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a light chain variable region comprising the amino acid sequence of SEQ ID NO:319. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:319. In some embodiments, a humanized anti-BACE1 antibody comprises a heavy chain variable region comprising the amino acid sequence of SEQ ID NO:315 and further comprises a light chain variable region comprising the amino acid sequence of SEQ ID NO:319.

Clone hu2H8v25: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310. In some embodiments, a humanized anti-BACE1 antibody comprises a heavy chain variable region comprising the amino acid sequence of SEQ ID NO:310. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:310 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:310 and further comprises a light chain variable region comprising the amino acid sequence of SEQ ID NO:320.

Clone hu2H8v26: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311. In some embodiments, a humanized anti-BACE1 antibody comprises a heavy chain variable region comprising the amino acid sequence of SEQ ID NO:311. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:311 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:311 and further comprises a light chain variable region comprising the amino acid sequence of SEQ ID NO:320.

Clone hu2H8v27: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312. In some embodiments, a humanized anti-BACE1 antibody comprises a heavy chain variable region comprising the amino acid sequence of SEQ ID NO:312. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:312 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:312 and further comprises a light chain variable region comprising the amino acid sequence of SEQ ID NO:320.

Clone hu2H8v28: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313. In some embodiments, a humanized anti-BACE1 antibody comprises a heavy chain variable region comprising the amino acid sequence of SEQ ID NO:313. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:313 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:313 and further comprises a light chain variable region comprising the amino acid sequence of SEQ ID NO:320.

Clone hu2H8v29: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:320.

Clone hu2H8v30: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315. In some embodiments, a humanized anti-BACE1 antibody comprises a heavy chain variable region comprising the amino acid sequence of SEQ ID NO:315. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:315 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:315 and further comprises a light chain variable region comprising the amino acid sequence of SEQ ID NO:320.

Clone hu2H8v29.1: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:437. In some embodiments, a humanized anti-BACE1 antibody comprises a light chain variable region comprising the amino acid sequence of SEQ ID NO:437. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:437. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:437.

Clone hu2H8v29.2: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:438. In some embodiments, a humanized anti-BACE1 antibody comprises a light chain variable region comprising the amino acid sequence of SEQ ID NO:438. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:438. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:438.

Clone hu2H8v29.3: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:439. In some embodiments, a humanized anti-BACE1 antibody comprises a light chain variable region comprising the amino acid sequence of SEQ ID NO:439. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:439. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:439.

Clone hu2H8v29.4: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:440. In some embodiments, a humanized anti-BACE1 antibody comprises a light chain variable region comprising the amino acid sequence of SEQ ID NO:440. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:440. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:440.

Clone hu2H8v29.5: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:441. In some embodiments, a humanized anti-BACE1 antibody comprises a light chain variable region comprising the amino acid sequence of SEQ ID NO:441. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:441. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:441.

Clone hu2H8v29.6: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:442. In some embodiments, a humanized anti-BACE1 antibody comprises a light chain variable region comprising the amino acid sequence of SEQ ID NO:442. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:442. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:442.

Clone hu2H8v29.7: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:443. In some embodiments, a humanized anti-BACE1 antibody comprises a light chain variable region comprising the amino acid sequence of SEQ ID NO:443. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:443. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:443.

Clone hu2H8v29.8: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:444. In some embodiments, a humanized anti-BACE1 antibody comprises a light chain variable region comprising the amino acid sequence of SEQ ID NO:444. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:444. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:444.

Clone hu2H8v29.9: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:445. In some embodiments, a humanized anti-BACE1 antibody comprises a light chain variable region comprising the amino acid sequence of SEQ ID NO:445. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:445. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:445.

Clone hu2H8v29.10: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:446. In some embodiments, a humanized anti-BACE1 antibody comprises a light chain variable region comprising the amino acid sequence of SEQ ID NO:446. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:446. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:446.

Clone hu2H8v29.11: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314. In some embodiments, a humanized anti-BACE1 antibody comprises a heavy chain variable region comprising the amino acid sequence of SEQ ID NO:314. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:447. In some embodiments, a humanized anti-BACE1 antibody comprises a light chain variable region comprising the amino acid sequence of SEQ ID NO:447. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:314 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:447. In some embodiments, a humanized anti-BACE1 antibody comprises a heavy chain variable region comprising the amino acid sequence of SEQ ID NO:314 and further comprises a light chain variable region comprising the amino acid sequence of SEQ ID NO:447.

Clone hu2H8v29.12: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:448. In some embodiments, a humanized anti-BACE1 antibody comprises a heavy chain variable region comprising the amino acid sequence of SEQ ID NO:448. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:448 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:448 and further comprises a light chain variable region comprising the amino acid sequence of SEQ ID NO:320.

Clone hu2H8v29.13: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:449. In some embodiments, a humanized anti-BACE1 antibody comprises a heavy chain variable region comprising the amino acid sequence of SEQ ID NO:449. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:449 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:449 and further comprises a light chain variable region comprising the amino acid sequence of SEQ ID NO:320.

Clone hu2H8v29.14: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:450. In some embodiments, a humanized anti-BACE1 antibody comprises a heavy chain variable region comprising the amino acid sequence of SEQ ID NO:450. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:450 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:450 and further comprises a light chain variable region comprising the amino acid sequence of SEQ ID NO:320.

Clone hu2H8v29.15: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:451. In some embodiments, a humanized anti-BACE1 antibody comprises a heavy chain variable region comprising the amino acid sequence of SEQ ID NO:451. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:451 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:451 and further comprises a light chain variable region comprising the amino acid sequence of SEQ ID NO:320.

Clone hu2H8v29.16: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:452. In some embodiments, a humanized anti-BACE1 antibody comprises a heavy chain variable region comprising the amino acid sequence of SEQ ID NO:452. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:452 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:452 and further comprises a light chain variable region comprising the amino acid sequence of SEQ ID NO:320.

Clone hu2H8v29.17: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:453. In some embodiments, a humanized anti-BACE1 antibody comprises a heavy chain variable region comprising the amino acid sequence of SEQ ID NO:453. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:453 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:453 and further comprises a light chain variable region comprising the amino acid sequence of SEQ ID NO:320.

Clone hu2H8v29.18: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:454. In some embodiments, a humanized anti-BACE1 antibody comprises a heavy chain variable region comprising the amino acid sequence of SEQ ID NO:454. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:454 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:454 and further comprises a light chain variable region comprising the amino acid sequence of SEQ ID NO:320.

Clone hu2H8v29.19: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:455. In some embodiments, a humanized anti-BACE1 antibody comprises a heavy chain variable region comprising the amino acid sequence of SEQ ID NO:455. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:455 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:455 and further comprises a light chain variable region comprising the amino acid sequence of SEQ ID NO:320.

Clone hu2H8v29.20: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:456. In some embodiments, a humanized anti-BACE1 antibody comprises a heavy chain variable region comprising the amino acid sequence of SEQ ID NO:456. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:456 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:456 and further comprises a light chain variable region comprising the amino acid sequence of SEQ ID NO:320.

Clone hu2H8v29.21: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:457. In some embodiments, a humanized anti-BACE1 antibody comprises a heavy chain variable region comprising the amino acid sequence of SEQ ID NO:457. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:457 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:457 and further comprises a light chain variable region comprising the amino acid sequence of SEQ ID NO:320.

Clone hu2H8v29.22: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:458. In some embodiments, a humanized anti-BACE1 antibody comprises a heavy chain variable region comprising the amino acid sequence of SEQ ID NO:458. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:458 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:458 and further comprises a light chain variable region comprising the amino acid sequence of SEQ ID NO:320.

Clone hu2H8v29.23: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:459. In some embodiments, a humanized anti-BACE1 antibody comprises a heavy chain variable region comprising the amino acid sequence of SEQ ID NO:459. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:459 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:459 and further comprises a light chain variable region comprising the amino acid sequence of SEQ ID NO:320.

Clone hu2H8v29.24: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:460. In some embodiments, a humanized anti-BACE1 antibody comprises a heavy chain variable region comprising the amino acid sequence of SEQ ID NO:460. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:460 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:460 and further comprises a light chain variable region comprising the amino acid sequence of SEQ ID NO:320.

Clone hu2H8v29.25: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:461. In some embodiments, a humanized anti-BACE1 antibody comprises a heavy chain variable region comprising the amino acid sequence of SEQ ID NO:461. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:461 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:461 and further comprises a light chain variable region comprising the amino acid sequence of SEQ ID NO:320.

Clone hu2H8v29.26: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:462. In some embodiments, a humanized anti-BACE1 antibody comprises a heavy chain variable region comprising the amino acid sequence of SEQ ID NO:462. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a light chain variable region comprising the amino acid sequence of SEQ ID NO:320. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:462 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:320. In some embodiments, a humanized anti-BACE1 antibody comprises a heavy chain variable region comprising the amino acid sequence of SEQ ID NO:462 and further comprises a light chain variable region comprising the amino acid sequence of SEQ ID NO:320.

Clone hu2H8v29.27: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:464. In some embodiments, a humanized anti-BACE1 antibody comprises a heavy chain variable region comprising the amino acid sequence of SEQ ID NO:464. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a light chain variable region comprising the amino acid sequence of SEQ ID NO:463. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:464 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a heavy chain variable region comprising the amino acid sequence of SEQ ID NO:464 and further comprises a light chain variable region comprising the amino acid sequence of SEQ ID NO:463.

Clone hu2H8v29.28: In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:465. In some embodiments, a humanized anti-BACE1 antibody comprises a heavy chain variable region comprising the amino acid sequence of SEQ ID NO:465. In some embodiments, a humanized anti-BACE1 antibody comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a light chain variable region comprising the amino acid sequence of SEQ ID NO:463. In some embodiments, a humanized anti-BACE1 antibody comprises a heavy chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:465 and further comprises a light chain variable region comprising an amino acid sequence that has at least 90% sequence identity (e.g., at least 91%, at least 92%, at least 93%, at least 94%, at least 95%, at least 96%, at least 97%, at least 98%, or at least 99% sequence identity) to SEQ ID NO:463. In some embodiments, a humanized anti-BACE1 antibody comprises a heavy chain variable region comprising the amino acid sequence of SEQ ID NO:465 and further comprises a light chain variable region comprising the amino acid sequence of SEQ ID NO:463.

In some embodiments, a humanized anti-BACE1 antibody is an antibody that competes for binding with an antibody as described herein (e.g., an antibody comprising a heavy chain variable region comprising the amino acid sequence of any one of SEQ ID NOs:310-315, 448-462, and 464-465 and/or a light chain variable region comprising the amino acid sequence of any one of SEQ ID NOs:316-320, 437-447, and 463).

V. PREPARATION OF ANTIBODIES

In some embodiments, antibodies are prepared by immunizing a mouse with an antigen or a mixture of antigens, or a combination thereof, for the induction of an antibody response. In some embodiments, the antigen or mixture of antigens, or a combination thereof, is administered in conjugation with an adjuvant (e.g., Freund's adjuvant). After an initial immunization, one or more subsequent booster injections of the antigen or antigens, or a combination thereof, may be administered to improve antibody production. Following immunization, antigen-specific B cells are harvested, e.g., from the spleen and/or lymphoid tissue. Methods of preparing antibodies are described in the Examples section below. In some embodiments, a method of preparing an anti-BACE1 antibody comprises immunizing a mousewith a full-length BACE1 protein (e.g., SEQ ID NO:305). In some embodiments, a method of preparing an anti-BACE1 antibody comprises immunizing an animal with a BACE1 protein that lacks a signal peptide, such as a pro form (e.g., SEQ ID NO:306) and/or a mature form (e.g., SEQ ID NO:307).

Phage or yeast display technology can be used to identify antibodies and Fab fragments that specifically bind to selected antigens. Alternatively, the genes encoding the heavy and light chains of an antibody of interest can be cloned from a cell, e.g., the genes encoding a monoclonal antibody can be cloned from a hybridoma and used to produce a recombinant monoclonal antibody. Gene libraries encoding heavy and light chains of monoclonal antibodies can also be made from hybridoma or plasma cells. Antibodies can also be made bispecific, i.e., able to recognize two different antigens. Antibodies can also be heteroconjugates, e.g., two covalently joined antibodies, or immunotoxins.

Antibodies can be produced using any number of expression systems, including prokaryotic and eukaryotic expression systems. In some embodiments, the expression system is a mammalian cell expression, such as a hybridoma, or a CHO cell expression system. Many such systems are widely available from commercial suppliers. In embodiments in which an antibody comprises both a VH and VL region, the VH and VL regions may be expressed using a single vector, e.g., in a di-cistronic expression unit, or under the control of different promoters. In other embodiments, the VH and VL regions may be expressed using separate vectors. A VH or VL region as described herein may optionally comprise a methionine at the N-terminus.

In some embodiments, the antibody is a chimeric antibody. Methods for making chimeric antibodies are known in the art. For example, chimeric antibodies can be made in which the antigen binding region (heavy chain variable region and light chain variable region) from one species, such as a mouse, is fused to the effector region (constant domain) of another species, such as a human. As another example, "class switched" chimeric antibodies can be made in which the effector region of an antibody is substituted with an effector region of a different immunoglobulin class or subclass.

In some embodiments, the antibody is a humanized antibody. Humanized antibodies are chimeric immunoglobulins that typically comprise one or more (e.g., two) variable domain(s), or portions thereof, in which the CDR regions substantially correspond to those of a non-human (e.g., murine) immunoglobulin sequence from which the humanized antibody is derived and the framework regions substantially correspond to those of a human immunoglobulin sequence. Possibly, some framework regions or portions thereof will be non-human. Humanized antibodies may further comprise one or more constant regions or portions thereof that are derived from human immunoglobulin sequences. Methods for humanizing non-human antibodies are known in the art. Transgenic mice, or other organisms such as other mammals, can be used to express humanized or human antibodies. Other methods of humanizing antibodies include, for example, variable region resurfacing, CDR grafting, grafting specificity-determining residues (SDR), guided selection, and framework shuffling.

As an alternative to humanization, fully human antibodies can be generated. As a non-limiting example, transgenic animals (e.g., mice) can be produced that are capable, upon immunization, of producing a full repertoire of human antibodies in the absence of endogenous immunoglobulin production. For example, it has been described that the homozygous deletion of the antibody heavy-chain joining region (JH) gene in chimeric and germ-line mutant mice results in complete inhibition of endogenous antibody production. Transfer of the human germ-line immunoglobulin gene array in such germ-line mutant mice will result in the production of human antibodies upon antigen challenge. As another example, human antibodies can be produced by hybridoma-based methods, such as by using primary human B cells for generating cell lines producing human monoclonal antibodies.

Human antibodies can also be produced using phage display or yeast display technology. In phage display, repertoires of variable heavy chain and variable light chain genes are amplified and expressed in phage display vectors. In some embodiments, the antibody library is a natural repertoire amplified from a human source. In some embodiments, the antibody library is a synthetic library made by cloning heavy chain and light chain sequences and recombining to generate a large pool of antibodies with different antigenic specificity. Phage typically display antibody fragments (e.g., Fab fragments or scFv fragments), which are then screened for binding to an antigen of interest.

In some embodiments, antibody fragments (such as a Fab, a Fab', a F(ab')$_2$, an scFv, a bivalent scFv, a $V_H$, a $V_{HH}$, a $V_{HH}$, or a $V_{NAR}$) are generated. Various techniques have been developed for the production of antibody fragments. Traditionally, these fragments were derived via proteolytic digestion of intact antibodies. However, these fragments can now be produced directly using recombinant host cells. For example, antibody fragments can be isolated from antibody phage libraries. Alternatively, Fab'-SH fragments can be directly recovered from E. coli cells and chemically coupled to form F(ab')$_2$ fragments. According to another approach, F(ab')$_2$ fragments can be isolated directly from recombinant host cell culture. Other techniques for the production of antibody fragments will be apparent to those skilled in the art.

In some embodiments, the antibody or an antibody portion thereof is conjugated to another molecule, e.g., polyethylene glycol (PEGylation) or serum albumin, to provide an extended half-life in vivo.

VI. MULTISPECIFIC ANTIBODIES

In some embodiments, multispecific antibodies comprising an anti-BACE1 antibody (or antigen-binding portion thereof) as described herein are provided, e.g., a bispecific antibody. In some embodiments, a multispecific antibody (e.g., a bispecific antibody) has a variable region-binding specificity for BACE1 and has a binding specificity for at least one other antigen. In some embodiments, a multispecific antibody (e.g., a bispecific antibody) binds to two different epitopes of BACE1.

In some embodiments, an anti-BACE1 antibody comprises: (a) a first antigen-binding portion comprising a first variable region that specifically binds to a BACE1 protein (e.g., human BACE1 protein), wherein the first antigen-binding portion comprises (i) a first heavy chain comprising a first Fc polypeptide and (ii) a first light chain; an (b) a second antigen-binding portion comprising a second variable region that specifically binds to the BACE1 protein (e.g., human BACE1 protein), wherein the second antigen-binding portion comprises (i) a second heavy chain comprising a second Fc polypeptide and (ii) a second light chain; wherein the first Fc polypeptide and the second Fc polypeptide form an Fc dimer.

In some embodiments, the first Fc polypeptide is a modified Fc polypeptide. In some embodiments, the second Fc polypeptide is a modified Fc polypeptide. In some embodiments, the first Fc polypeptide is a modified Fc polypeptide and/or the second Fc polypeptide is a modified Fc polypeptide.

In some embodiments, an anti-BACE1 antibody comprises: (a) a first antigen-binding portion comprising a first variable region that specifically binds to a BACE1 protein (e.g., human BACE1 protein), wherein the first antigen-binding portion comprises (i) a first heavy chain comprising a first Fc polypeptide and (ii) a first light chain; and (b) a second antigen-binding portion comprising a second variable region that specifically binds to the BACE1 protein (e.g., human BACE1 protein), wherein the second antigen-binding portion comprises (i) a second heavy chain comprising a second Fc polypeptide and (ii) a second light chain; wherein the first Fc polypeptide and the second Fc polypeptide form an Fc dimer and wherein the first Fc polypeptide is a modified Fc polypeptide and/or the second Fc polypeptide is a modified Fc polypeptide.

In some embodiments, the first and second variable regions recognize the same epitope in the BACE1 protein. In some embodiments, the first and second variable regions recognize different epitopes in the BACE1 protein.

Methods for making multispecific antibodies include, but are not limited to, recombinant co-expression of two pairs of heavy chain and light chain in a host cell, "knobs-into-holes" engineering, intramolecular trimerization, and fusion of an antibody fragment to the N-terminus or C-terminus of another antibody, e.g., tandem variable domains.

VII. NUCLEIC ACIDS, VECTORS, AND HOST CELLS

In some embodiments, the anti-BACE1 antibodies as described herein are prepared using recombinant methods. Accordingly, in some aspects, the disclosure provides isolated nucleic acids comprising a nucleic acid sequence encoding any of the anti-BACE1 antibodies as described herein (e.g., any one or more of the CDRs, heavy chain variable regions, and light chain variable regions described herein); vectors comprising such nucleic acids; and host cells into which the nucleic acids are introduced that are used to replicate the antibody-encoding nucleic acids and/or to express the antibodies.

In some embodiments, a polynucleotide (e.g., an isolated polynucleotide) comprises a nucleotide sequence encoding an antibody or antigen-binding portion thereof as described herein (e.g., as described in the section above entitled "Anti-BACE1 Antibody Sequences"). In some embodiments, the polynucleotide comprises a nucleotide sequence encoding one or more amino acid sequences (e.g., CDR, heavy chain, light chain, and/or framework regions) disclosed in Table 12 below. In some embodiments, the polynucleotide comprises a nucleotide sequence encoding an amino acid sequence having at least 85% sequence identity (e.g., at least 85%, at least 90%, at least 91%, at least 92%, at least 93%, at least 94%, at least 95%, at least 96%, at least 97%, at least 98%, or at least 99% sequence identity) to a sequence (e.g., a CDR, heavy chain, light chain, or framework region sequence) disclosed in Table 12 below. In some embodiments, a polynucleotide as described herein is operably linked to a heterologous nucleic acid, e.g., a heterologous promoter.

Suitable vectors containing polynucleotides encoding antibodies of the present disclosure, or portions thereof, include cloning vectors and expression vectors. While the cloning vector selected may vary according to the host cell intended to be used, useful cloning vectors generally have the ability to self-replicate, may possess a single target for a particular restriction endonuclease, and/or may carry genes for a marker that can be used in selecting clones containing the vector. Examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Strategene, and Invitrogen.

Expression vectors generally are replicable polynucleotide constructs that contain a nucleic acid of the present disclosure. The expression vector may replicate in the host cells either as episomes or as an integral part of the chromosomal DNA. Suitable expression vectors include but are not limited to plasmids, viral vectors, including adenoviruses, adeno-associated viruses, retroviruses, and any other vector.

Suitable host cells for cloning or expressing a polynucleotide or vector as described herein include prokaryotic or eukaryotic cells. In some embodiments, the host cell is prokaryotic. In some embodiments, the host cell is eukaryotic, e.g., Chinese Hamster Ovary (CHO) cells or lymphoid cells. In some embodiments, the host cell is a human cell, e.g., a Human Embryonic Kidney (HEK) cell.

In a further aspect, methods of making an anti-BACE1 antibody as described herein are provided. In some embodiments, the method includes culturing a host cell as described herein (e.g., a host cell expressing a polynucleotide or vector as described herein) under conditions suitable for expression of the antibody. In some embodiments, the antibody is subsequently recovered from the host cell (or host cell culture medium).

VIII. FC POLYPEPTIDE MODIFICATIONS FOR BLOOD-BRAIN BARRIER (BBB) RECEPTOR BINDING

In some aspects, provided herein are anti-BACE1 antibodies that are capable of being transported across the blood-brain barrier (BBB). Such a protein comprises a modified Fc polypeptide that binds to a BBB receptor. BBB receptors are expressed on BBB endothelia, as well as other cell and tissue types. In some embodiments, the BBB receptor is a transferrin receptor (TfR).

Amino acid residues designated in various Fc modifications, including those introduced in a modified Fc polypeptide that binds to a BBB receptor, e.g., TfR, are numbered herein using EU index numbering. Any Fc polypeptide, e.g., an IgG1, IgG2, IgG3, or IgG4 Fc polypeptide, may have modifications, e.g., amino acid substitutions, in one or more positions as described herein.

In some embodiments, an anti-BACE1 antibody comprises a first and optionally a second Fc polypeptide, each of which can be independently modified. In some embodiments, modifications (e.g., that promote TfR binding) that are made to the first and/or second Fc polypeptides result in an increase in brain uptake of the antibody (or antigen-binding portion thereof) of at least about 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, or more, compared to the uptake without the modifications having been made.

A modified (e.g., enhancing heterodimerization and/or BBB receptor-binding) Fc polypeptide can have at least 70% identity, at least 75% identity, at least 80% identity, at least 85% identity, at least 90% identity, or at least 95% identity to a native Fc region sequence or a fragment thereof, e.g., a fragment of at least 50 amino acids or at least 100 amino acids, or greater in length. In some embodiments, the native Fc amino acid sequence is the Fc region sequence of SEQ ID NO:302. In some embodiments, the modified Fc polypeptide has at least 70% identity, at least 75% identity, at least 80% identity, at least 85% identity, at least 90% identity, or at least 95% identity to amino acids 1-110 of SEQ ID NO:302, or to amino acids 111-217 of SEQ ID NO:302, or a fragment thereof, e.g., a fragment of at least 50 amino acids or at least 100 amino acids, or greater in length.

In some embodiments, a modified (e.g., enhancing heterodimerization and/or BBB receptor-binding) Fc polypeptide comprises at least 50 amino acids, or at least 60, 65, 70, 75, 80, 85, 90, or 95 or more, or at least 100 amino acids, or more, that correspond to a native Fc region amino acid sequence. In some embodiments, the modified Fc polypeptide comprises at least 25 contiguous amino acids, or at least 30, 35, 40, or 45 contiguous amino acids, or 50 contiguous amino acids, or at least 60, 65, 70, 75, 80 85, 90, or 95 or more contiguous amino acids, or 100 or more contiguous amino acids, that correspond to a native Fc region amino acid sequence, such as SEQ ID NO:302.

In some embodiments, the domain that is modified for BBB receptor-binding activity is a human Ig CH3 domain, such as an IgG1 CH3 domain. The CH3 domain can be of any IgG subtype, i.e., from IgG1, IgG2, IgG3, or IgG4. In the context of IgG1 antibodies, a CH3 domain refers to the segment of amino acids from about position 341 to about position 447 as numbered according to the EU numbering scheme.

In some embodiments, the domain that is modified for BBB receptor-binding activity is a human Ig CH2 domain, such as an IgG CH2 domain. The CH2 domain can be of any IgG subtype, i.e., from IgG1, IgG2, IgG3, or IgG4. In the context of IgG1 antibodies, a CH2 domain refers to the segment of amino acids from about position 231 to about position 340 as numbered according to the EU numbering scheme.

In some embodiments, a modified (e.g., BBB receptor-binding) Fc polypeptide comprises at least one, two, or three substitutions; and in some embodiments, at least four five, six, seven, eight, nine, or ten substitutions at amino acid positions comprising 266, 267, 268, 269, 270, 271, 295, 297, 298, and 299, according to the EU numbering scheme.

In some embodiments, a modified (e.g., BBB receptor-binding) Fc polypeptide comprises at least one, two, or three substitutions; and in some embodiments, at least four, five, six, seven, eight, or nine substitutions at amino acid positions comprising 274, 276, 283, 285, 286, 287, 288, 289, and 290, according to the EU numbering scheme.

In some embodiments, a modified (e.g., BBB receptor-binding) Fc polypeptide comprises at least one, two, or three substitutions; and in some embodiments, at least four, five, six, seven, eight, nine, or ten substitutions at amino acid positions comprising 268, 269, 270, 271, 272, 292, 293, 294, 296, and 300, according to the EU numbering scheme.

In some embodiments, a modified (e.g., BBB receptor-binding) Fc polypeptide comprises at least one, two, or three substitutions; and in some embodiments, at least four, five, six, seven, eight, or nine substitutions at amino acid positions comprising 272, 274, 276, 322, 324, 326, 329, 330, and 331, according to the EU numbering scheme.

In some embodiments, a modified (e.g., BBB receptor-binding) Fc polypeptide comprises at least one, two, or three substitutions; and in some embodiments, at least four, five, six, or seven substitutions at amino acid positions comprising 345, 346, 347, 349, 437, 438, 439, and 440, according to the EU numbering scheme.

In some embodiments, a modified (e.g., BBB receptor-binding) Fc polypeptide comprises at least one, two, or three substitutions; and in some embodiments, at least four, five, six, seven, eight, or nine substitutions at amino acid positions 384, 386, 387, 388, 389, 390, 413, 416, and 421, according to the EU numbering scheme.

In some embodiments, an anti-BACE1 antibody comprises two Fc polypeptides, wherein one Fc polypeptide is not modified to bind to a BBB receptor (e.g., TfR) and the other Fc polypeptide is modified to specifically bind to a BBB receptor (e.g., TfR).

FcRn Binding Sites

In certain aspects, modified (e.g., BBB receptor-binding) Fc polypeptides, or Fc polypeptides that do not specifically bind to a BBB receptor, can also comprise an FcRn binding site. In some embodiments, the FcRn binding site is within the Fc polypeptide or a fragment thereof.

In some embodiments, the FcRn binding site comprises a native FcRn binding site. In some embodiments, the FcRn binding site does not comprise amino acid changes relative to the amino acid sequence of a native FcRn binding site. In some embodiments, the native FcRn binding site is an IgG binding site, e.g., a human IgG binding site. In some embodiments, the FcRn binding site comprises a modification that alters FcRn binding.

In some embodiments, one or more Fc polypeptides (e.g., a first Fc polypeptide, a second Fc polypeptide, or a first and second Fc polypeptide) contain modifications that affect (e.g., increase) FcRn binding. In some embodiments, an FcRn binding site has one or more amino acid residues that are mutated, e.g., substituted, wherein the mutation(s) increase serum stability or serum half-life or do not substantially reduce serum stability or serum half-life (i.e., reduce serum stability or serum half-life by no more than 25% compared to a counterpart modified Fc polypeptide having the wild-type residues at the mutated positions when assayed under the same conditions). In some embodiments, an FcRn binding site has one or more amino acid residues that are substituted at positions 250-256, 307, 380, 428, and 433-436, according to the EU numbering scheme.

In some embodiments, one or more residues at or near an FcRn binding site are mutated, relative to a native human IgG sequence, to extend serum stability or serum half-life of the modified polypeptide. In some embodiments, mutations are introduced into one, two, or three of positions 252, 254, and 256. In some embodiments, the mutations are M252Y, S254T, and T256E. In some embodiments, a modified Fc polypeptide further comprises the mutations M252Y, S254T, and T256E. In some embodiments, the mutations are M428L and/or N434S. In some embodiments, a modified Fc polypeptide further comprises the mutation N434S with or without M428L. In some embodiments, a modified Fc polypeptide comprises a substitution at one, two, or all three of positions T307, E380, and N434, according to the EU numbering scheme. In some embodiments, the mutations are T307Q and N434A. In some embodiments, a modified Fc polypeptide comprises mutations T307A, E380A, and N434A. In some embodiments, a modified Fc polypeptide comprises substitutions at positions T250 and M428, according to the EU numbering scheme. In some embodiments, the modified Fc polypeptide comprises mutations T250Q and/or M428L. In some embodiments, a modified Fc polypeptide comprises mutations at positions M428 and N434, according to the EU numbering scheme. In some embodiments, the modified Fc polypeptide comprises mutations M428L and N434S. In some embodiments, the modified Fc polypeptide comprises an N434S or N434A mutation.

IX. TRANSFERRIN RECEPTOR-BINDING FC POLYPEPTIDES

This section describes generation of modified Fc polypeptides in accordance with the disclosure that bind to transferrin receptor (TfR) and are capable of being transported across the blood-brain barrier (BBB).

TfR-Binding Fc Polypeptides Comprising Mutations in the CH3 Domain

In some embodiments, a modified Fc polypeptide that specifically binds to TfR comprises substitutions in a CH3 domain. In some embodiments, a modified Fc polypeptide comprises a human Ig CH3 domain, such as an IgG CH3 domain, that is modified for TfR-binding activity. The CH3 domain can be of any IgG subtype, i.e., from IgG1, IgG2, IgG3, or IgG4. In the context of IgG antibodies, a CH3 domain refers to the segment of amino acids from about position 341 to about position 447 as numbered according to the EU numbering scheme.

In some embodiments, a modified Fc polypeptide that specifically binds to TfR binds to the apical domain of TfR and may bind to TfR without blocking or otherwise inhibiting binding of transferrin to TfR. In some embodiments, binding of transferrin to TfR is not substantially inhibited. In some embodiments, binding of transferrin to TfR is inhibited by less than about 50% (e.g., less than about 45%, 40%, 35%, 30%, 25%, 20%, 15%, 10%, or 5%). In some embodiments, binding of transferrin to TfR is inhibited by less than about 20% (e.g., less than about 19%, 18%, 17%, 16%, 15%, 14%, 13%, 12%, 11%, 10%, 9%, 8%, 7%, 6%, 5%, 4%, 3%, 2%, or 1%).

In some embodiments, a modified Fc polypeptide that specifically binds to TfR comprises at least two, three, four, five, six, seven, eight, or nine substitutions at positions 384, 386, 387, 388, 389, 390, 413, 416, and 421, according to the EU numbering scheme. Illustrative substitutions that may be introduced at these positions are shown in Tables 7 and 8. In some embodiments, the amino acid at position 388 and/or 421 is an aromatic amino acid, e.g., Trp, Phe, or Tyr. In some embodiments, the amino acid at position 388 is Trp. In some embodiments, the aromatic amino acid at position 421 is Trp or Phe.

In some embodiments, at least one position as follows is substituted: Leu, Tyr, Met, or Val at position 384; Leu, Thr, His, or Pro at position 386; Val, Pro, or an acidic amino acid at position 387; an aromatic amino acid, e.g. Trp at position 388; Val, Ser, or Ala at position 389; an acidic amino acid, Ala, Ser, Leu, Thr, or Pro at position 413; Thr or an acidic amino acid at position 416; or Trp, Tyr, His, or Phe at position 421. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set. Thus, for example, Ile may be present at position 384, 386, and/or position 413. In some embodiments, the acidic amino acid at position one, two, or each of positions 387, 413, and 416 is Glu. In other embodiments, the acidic amino acid at one, two or each of positions 387, 413, and 416 is Asp. In some embodiments, two, three, four, five, six, seven, or all eight of positions 384, 386, 387, 388, 389, 413, 416, and 421 have an amino acid substitution as specified in this paragraph.

In some embodiments, an Fc polypeptide that is modified as described in the preceding two paragraphs comprises a native Asn at position 390. In some embodiments, the modified Fc polypeptide comprises Gly, His, Gln, Leu, Lys, Val, Phe, Ser, Ala, or Asp at position 390. In some embodiments, the modified Fc polypeptide further comprises one, two, three, or four substitutions at positions comprising 380, 391, 392, and 415, according to the EU numbering scheme. In some embodiments, Trp, Tyr, Leu, or Gln may be present at position 380. In some embodiments, Ser, Thr, Gln, or Phe may be present at position 391. In some embodiments, Gln, Phe, or His may be present at position 392. In some embodiments, Glu may be present at position 415.

In certain embodiments, the modified Fc polypeptide comprises two, three, four, five, six, seven, eight, nine, ten, or eleven positions selected from the following: Trp, Leu, or Glu at position 380; Tyr or Phe at position 384; Thr at position 386; Glu at position 387; Trp at position 388; Ser, Ala, Val, or Asn at position 389; Ser or Asn at position 390; Thr or Ser at position 413; Glu or Ser at position 415; Glu at position 416; and/or Phe at position 421. In some embodiments, the modified Fc polypeptide comprises all eleven positions as follows: Trp, Leu, or Glu at position 380; Tyr or Phe at position 384; Thr at position 386; Glu at position 387; Trp at position 388; Ser, Ala, Val, or Asn at position 389; Ser or Asn at position 390; Thr or Ser at position 413; Glu or Ser at position 415; Glu at position 416; and/or Phe at position 421.

In certain embodiments, the modified Fc polypeptide comprises Leu or Met at position 384; Leu, His, or Pro at position 386; Val at position 387; Trp at position 388; Val or Ala at position 389; Pro at position 413; Thr at position 416; and/or Trp at position 421. In some embodiments, the modified Fc polypeptide further comprises Ser, Thr, Gln, or Phe at position 391. In some embodiments, the modified Fc polypeptide further comprises Trp, Tyr, Leu, or Gln at position 380 and/or Gln, Phe, or His at position 392. In some embodiments, Trp is present at position 380 and/or Gln is present at position 392. In some embodiments, the modified Fc polypeptide does not have a Trp at position 380.

In other embodiments, the modified Fc polypeptide comprises Tyr at position 384; Thr at position 386; Glu or Val and position 387; Trp at position 388; Ser at position 389; Ser or Thr at position 413; Glu at position 416; and/or Phe at position 421. In some embodiments, the modified Fc polypeptide comprises a native Asn at position 390. In certain embodiments, the modified Fc polypeptide further comprises Trp, Tyr, Leu, or Gln at position 380; and/or Glu at position 415. In some embodiments, the modified Fc polypeptide further comprises Trp at position 380 and/or Glu at position 415.

In additional embodiments, the modified Fc polypeptide further comprises one, two, or three substitutions at positions comprising 414, 424, and 426, according to the EU numbering scheme. In some embodiments, position 414 is Lys, Arg, Gly, or Pro; position 424 is Ser, Thr, Glu, or Lys; and/or position 426 is Ser, Trp, or Gly.

In some embodiments, the modified Fc polypeptide comprises one or more of the following substitutions: Trp at position 380; Thr at position 386; Trp at position 388; Val at position 389; Thr or Ser at position 413; Glu at position 415; and/or Phe at position 421, according to the EU numbering scheme.

In some embodiments, the modified Fc polypeptide has at least 70% identity, at least 75% identity, at least 80% identity, at least 85% identity, at least 90% identity, or at least 95% identity to amino acids 111-217 of any one of SEQ ID NOs:183-276, 321-392, 471-477, and 603-610 (e.g., SEQ ID NOs:183-219 and 471-477). In some embodiments, the modified Fc polypeptide has at least 70% identity, at least 75% identity, at least 80% identity, at least 85% identity, at least 90% identity, or at least 95% identity to any one of SEQ ID NOs:183-276, 321-392, 471-477, and 603-610 (e.g., SEQ ID NOs:183-219 and 471-477). In some embodiments, the modified Fc polypeptide comprises the amino acids at EU index positions 384-390 and/or 413-421 of any one of SEQ ID NOs:183-276, 321-392, 471-477, and 603-610 (e.g., SEQ ID NOs:183-219 and 471-477). In some embodiments, the modified Fc polypeptide comprises the amino acids at EU index positions 380-390 and/or 413-421 of any one of SEQ ID NOs:183-276, 321-392, 471-477, and 603-610 (e.g., SEQ ID NOs:183-219 and 471-477). In some embodiments, the modified Fc polypeptide comprises the amino acids at EU index positions 380-392 and/or 413-426 of any one of SEQ ID NOs:183-276, 321-392, 471-477, and 603-610 (e.g., SEQ ID NOs:183-219 and 471-477).

In some embodiments, the modified Fc polypeptide has at least 75% identity, at least 80% identity, at least 85% identity, at least 90% identity, or at least 95% identity to any one of SEQ ID NOs:183-276, 321-392, 471-477, and 603-610 (e.g., SEQ ID NOs:183-219 and 471-477), and further comprises at least five, six, seven, eight, nine, ten, eleven, twelve, thirteen, fourteen, fifteen, or sixteen of the positions, numbered according to the EU index, as follows: Trp, Tyr, Leu, Gln, or Glu at position 380; Leu, Tyr, Met, or Val at position 384; Leu, Thr, His, or Pro at position 386; Val, Pro, or an acidic amino acid at position 387; an aromatic amino acid, e.g. Trp, at position 388; Val, Ser, or Ala at position 389; Ser or Asn at position 390; Ser, Thr, Gln, or Phe at position 391; Gln, Phe, or His at position 392; an acidic amino acid, Ala, Ser, Leu, Thr, or Pro at position 413; Lys, Arg, Gly or Pro at position 414; Glu or Ser at position 415; Thr or an acidic amino acid at position 416; Trp, Tyr, His or Phe at position 421; Ser, Thr, Glu or Lys at position 424; and Ser, Trp, or Gly at position 426.

In some embodiments, the modified Fc polypeptide comprises the amino acid sequence of any one of SEQ ID NOs:183-219 and 471-477. In other embodiments, the modified Fc polypeptide comprises the amino acid sequence of any one of SEQ ID NOs:183-219 and 471-477, but in which one, two, or three amino acids are substituted.

In some embodiments, the modified Fc polypeptide comprises additional mutations such as the mutations described herein, including, but not limited to, a knob mutation (e.g., T366W as numbered with reference to EU numbering), hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and/or mutations that increase serum stability or serum half-life (e.g., M252Y, S254T, and T256E as numbered with reference to EU numbering). By way of illustration, SEQ ID NOs:321-392 and 478-595 provide non-limiting examples of modified Fc polypeptides with mutations in the CH3 domain (e.g., CH3C.35.20.1, CH3C.35.23.2, CH3C.35.23.3, CH3C.35.23.4, CH3C.35.21.17.2, CH3C.35.23, CH3C.35.21, CH3C.35.20.1.1, CH3C.23.2.1, and CH3C.35.23.1.1) comprising one or more of these additional mutations.

In some embodiments, the modified Fc polypeptide comprises a knob mutation (e.g., T366W as numbered with reference to EU numbering) and has at least 85% identity, at least 90% identity, or at least 95% identity to the sequence of any one of SEQ ID NOs:321, 333, 345, 357, 369, 381, 478, 490, 502, and 514. In some embodiments, the modified Fc polypeptide comprises the sequence of any one of SEQ ID NOs:321, 333, 345, 357, 369, 381, 478, 490, 502, and 514.

In some embodiments, the modified Fc polypeptide comprises a knob mutation (e.g., T366W as numbered with reference to EU numbering) and mutations that modulate effector function (e.g., L234A, L235A, and/or P329G (e.g., L234A and L235A) as numbered with reference to EU numbering), and has at least 85% identity, at least 90% identity, or at least 95% identity to the sequence of any one of SEQ ID NOs:322, 323, 334, 335, 346, 347, 358, 359, 370, 371, 382, 383, 479, 480, 491, 492, 503, 504, 515, and 516. In some embodiments, the modified Fc polypeptide comprises the sequence of any one of SEQ ID NOs:322, 323, 334, 335, 346, 347, 358, 359, 370, 371, 382, 383, 479, 480, 491, 492, 503, 504, 515, and 516.

In some embodiments, the modified Fc polypeptide comprises a knob mutation (e.g., T366W as numbered with reference to EU numbering) and mutations that increase serum stability or serum half-life (e.g., M252Y, S254T, and T256E as numbered with reference to EU numbering), and has at least 85% identity, at least 90% identity, or at least 95% identity to the sequence of any one of SEQ ID NOs:324, 336, 348, 360, 372, 384, and 481, 493, 505, and 517. In some embodiments, the modified Fc polypeptide comprises the sequence of any one of SEQ ID NOs:324, 336, 348, 360, 372, 384, 481, 493, 505, and 517.

In some embodiments, the modified Fc polypeptide comprises a knob mutation (e.g., T366W as numbered with reference to EU numbering) and mutations that increase serum stability or serum half-life (e.g., N434S with or without M428L as numbered with reference to EU numbering), and has at least 85% identity, at least 90% identity, or at least 95% identity to the sequence of any one of SEQ ID NOs:527, 534, 541, 548, 555, 562, 569, 576, 583, and 590. In some embodiments, the modified Fc polypeptide comprises the sequence of any one of SEQ ID NOs:527, 534, 541, 548, 555, 562, 569, 576, 583, and 590.

In some embodiments, the modified Fc polypeptide comprises a knob mutation (e.g., T366W as numbered with reference to EU numbering), mutations that modulate effector function (e.g., L234A, L235A, and/or P329G (e.g., L234A and L235A) as numbered with reference to EU numbering), and mutations that increase serum stability or serum half-life (e.g., M252Y, S254T, and T256E as numbered with reference to EU numbering), and has at least 85% identity, at least 90% identity, or at least 95% identity to the sequence of any one of SEQ ID NOs:325, 326, 337, 338, 349, 350, 361, 362, 373, 374, 385, 386, 482, 483, 494, 495, 506, 507, 518, and 519. In some embodiments, the modified Fc polypeptide comprises the sequence of any one of SEQ ID NOs:325, 326, 337, 338, 349, 350, 361, 362, 373, 374, 385, 386, 482, 483, 494, 495, 506, 507, 518, and 519.

In some embodiments, the modified Fc polypeptide comprises a knob mutation (e.g., T366W as numbered with reference to EU numbering), mutations that modulate effector function (e.g., L234A, L235A, and/or P329G (e.g., L234A and L235A) as numbered with reference to EU numbering), and mutations that increase serum stability or serum half-life (e.g., N434S with or without M428L as numbered with reference to EU numbering), and has at least 85% identity, at least 90% identity, or at least 95% identity to the sequence of any one of SEQ ID NOs:528, 529, 535, 536, 542, 543, 549, 550, 556, 557, 563, 564, 570, 571, 577, 578, 584, 585, 591, and 592. In some embodiments, the modified Fc polypeptide comprises the sequence of any one of SEQ ID NOs:528, 529, 535, 536, 542, 543, 549, 550, 556, 557, 563, 564, 570, 571, 577, 578, 584, 585, 591, and 592.

In some embodiments, the modified Fc polypeptide comprises hole mutations (e.g., T366S, L368A, and Y407V as numbered with reference to EU numbering) and has at least 85% identity, at least 90% identity, or at least 95% identity to the sequence of any one of SEQ ID NOs:327, 339, 351, 363, 375, 387, 484, 496, 508, and 520. In some embodiments, the modified Fc polypeptide comprises the sequence of any one of SEQ ID NOs:327, 339, 351, 363, 375, 387, 484, 496, 508, and 520.

In some embodiments, the modified Fc polypeptide comprises hole mutations (e.g., T366S, L368A, and Y407V as numbered with reference to EU numbering) and mutations that modulate effector function (e.g., L234A, L235A, and/or P329G (e.g., L234A and L235A) as numbered with reference to EU numbering), and has at least 85% identity, at least 90% identity, or at least 95% identity to the sequence of any one of SEQ ID NOs:328, 329, 340, 341, 352, 353, 364, 365, 376, 377, 388, 389, 485, 486, 497, 498, 509, 510, 521, and 522. In some embodiments, the modified Fc polypeptide comprises the sequence of any one of SEQ ID NOs:328, 329, 340, 341, 352, 353, 364, 365, 376, 377, 388, 389, 485, 486, 497, 498, 509, 510, 521, and 522.

In some embodiments, the modified Fc polypeptide comprises hole mutations (e.g., T366S, L368A, and Y407V as numbered with reference to EU numbering) and mutations that increase serum stability or serum half-life (e.g., M252Y, S254T, and T256E as numbered with reference to EU numbering), and has at least 85% identity, at least 90% identity, or at least 95% identity to the sequence of any one of SEQ ID NOs:330, 342, 354, 366, 378, 390, 487, 499, 511, and 523. In some embodiments, the modified Fc polypeptide comprises the sequence of any one of SEQ ID NOs:330, 342, 354, 366, 378, 390, 487, 499, 511, and 523.

In some embodiments, the modified Fc polypeptide comprises hole mutations (e.g., T366S, L368A, and Y407V as numbered with reference to EU numbering) and mutations that increase serum stability or serum half-life (e.g., N434S with or without M428L as numbered with reference to EU numbering), and has at least 85% identity, at least 90% identity, or at least 95% identity to the sequence of any one of SEQ ID NOs:530, 537, 544, 551, 558, 565, 572, 579, 586, and 593. In some embodiments, the modified Fc polypeptide comprises the sequence of any one of SEQ ID NOs:530, 537, 544, 551, 558, 565, 572, 579, 586, and 593.

In some embodiments, the modified Fc polypeptide comprises hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and mutations that increase serum stability or serum half-life (e.g., M252Y, S254T, and T256E as numbered with reference to EU numbering), and has at least 85% identity, at least 90% identity, or at least 95% identity to the sequence of any one of SEQ ID NOs:331, 332, 343, 344, 355, 356, 367, 368, 379, 380, 391, 392, 488, 489, 500, 501, 512, 513, 524, and 525. In some embodiments, the modified Fc polypeptide comprises the sequence of any one of SEQ ID NOs:331, 332, 343, 344, 355, 356, 367, 368, 379, 380, 391, 392, 488, 489, 500, 501, 512, 513, 524, and 525.

In some embodiments, the modified Fc polypeptide comprises hole mutations (e.g., T366S, L368A, and Y407V as numbered with reference to EU numbering), mutations that modulate effector function (e.g., L234A, L235A, and/or P329G (e.g., L234A and L235A) as numbered with reference to EU numbering), and mutations that increase serum stability or serum half-life (e.g., N434S with or without M428L as numbered with reference to EU numbering), and has at least 85% identity, at least 90% identity, or at least 95% identity to the sequence of any one of SEQ ID NOs:531, 532, 538, 539, 545, 546, 552, 553, 559, 560, 566, 567, 573, 574, 580, 581, 587, 588, 594, and 595. In some embodiments, the modified Fc polypeptide comprises the sequence of any one of SEQ ID NOs:531, 532, 538, 539, 545, 546, 552, 553, 559, 560, 566, 567, 573, 574, 580, 581, 587, 588, 594, and 595.

In some embodiments, a modified Fc polypeptide that specifically binds to TfR comprises at least two, three, four, five, six, seven, or eight substitutions at positions 345, 346, 347, 349, 437, 438, 439, and 440, according to the EU numbering scheme. Illustrative modified Fc polypeptides are provided in SEQ ID NOs:277-281. In some embodiments, the modified Fc polypeptide comprises Gly at position 437; Phe at position 438; and/or Asp at position 440. In some embodiments, Glu is present at position 440. In certain embodiments, the modified Fc polypeptide comprises at least one substitution at a position as follows: Phe or Ile at position 345; Asp, Glu, Gly, Ala, or Lys at position 346; Tyr, Met, Leu, Ile, or Asp at position 347; Thr or Ala at position 349; Gly at position 437; Phe at position 438; His Tyr, Ser, or Phe at position 439; or Asp at position 440. In some embodiments, two, three, four, five, six, seven, or all eight of positions 345, 346, 347, 349, 437, 438, 439, and 440 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide has at least 70% identity, at least 75% identity, at least 80% identity, at least 85% identity, at least 90% identity, or at least 95% identity to amino acids 111-217 of any one of SEQ ID NOs:277-281. In some embodiments, the modified Fc polypeptide has at least 70% identity, at least 75% identity, at least 80% identity, at least 85% identity, at least 90% identity, or at least 95% identity to SEQ ID NOs:277-281. In some embodiments, the modified Fc polypeptide comprises the amino acid sequence of any one of SEQ ID NOs:277-281. In other embodiments, the modified Fc polypeptide comprises the amino acid sequence of any one of SEQ ID NOs:277-281, but in which one, two, or three amino acids are substituted.

TfR-Binding Fc Polypeptides Comprising Mutations in the CH2 Domain

In some embodiments, a modified Fc polypeptide that specifically binds to TfR comprises substitutions in a CH2 domain. In some embodiments, a modified Fc polypeptide comprises a human Ig CH2 domain, such as an IgG CH2 domain, that is modified for TfR-binding activity. The CH2 domain can be of any IgG subtype, i.e., from IgG1, IgG2, IgG3, or IgG4. In the context of IgG antibodies, a CH2 domain refers to the segment of amino acids from about position 231 to about position 340 as numbered according to the EU numbering scheme.

In some embodiments, a modified Fc polypeptide that specifically binds to TfR binds to the apical domain of TfR and may bind to TfR without blocking or otherwise inhibiting binding of transferrin to TfR. In some embodiments, binding of transferrin to TfR is not substantially inhibited. In some embodiments, binding of transferrin to TfR is inhibited by less than about 50% (e.g., less than about 45%, 40%, 35%, 30%, 25%, 20%, 15%, 10%, or 5%). In some embodiments, binding of transferrin to TfR is inhibited by less than about 20% (e.g., less than about 19%, 18%, 17%, 16%, 15%, 14%, 13%, 12%, 11%, 10%, 9%, 8%, 7%, 6%, 5%, 4%, 3%, 2%, or 1%).

In some embodiments, a modified Fc polypeptide that specifically binds to TfR comprises at least two, three, four, five, six, seven, eight, or nine substitutions at positions 274, 276, 283, 285, 286, 287, 288, and 290, according to the EU numbering scheme. Illustrative modified Fc polypeptides are provided in SEQ ID NOs:282-286. In some embodiments, the modified Fc polypeptide comprises Glu at position 287 and/or Trp at position 288. In some embodiments, the modified Fc polypeptide comprises at least one substitution at a position as follows: Glu, Gly, Gln, Ser, Ala, Asn, Tyr, or Trp at position 274; Ile, Val, Asp, Glu, Thr, Ala, or Tyr at position 276; Asp, Pro, Met, Leu, Ala, Asn, or Phe at position 283; Arg, Ser, Ala, or Gly at position 285; Tyr, Trp, Arg, or Val at position 286; Glu at position 287; Trp or Tyr at position 288; Gln, Tyr, His, Ile, Phe, Val, or Asp at position 289; or Leu, Trp, Arg, Asn, Tyr, or Val at position 290. In some embodiments, two, three, four, five, six, seven, eight, or all nine of positions 274, 276, 283, 285, 286, 287, 288, and 290 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Glu, Gly, Gln, Ser, Ala, Asn, or Tyr at position 274; Ile, Val, Asp, Glu, Thr, Ala, or Tyr at position 276 Asp, Pro, Met, Leu, Ala, or Asn at position 283; Arg, Ser, or Ala at position 285; Tyr, Trp, Arg, or Val at position 286; Glu at position 287; Trp at position 288; Gln, Tyr, His, Ile, Phe, or Val at position 289; and/or Leu, Trp, Arg, Asn, or Tyr at position 290. In some embodiments, the modified Fc polypeptide comprises Arg at position 285; Tyr or Trp at position 286; Glu at position 287; Trp at position 288; and/or Arg or Trp at position 290.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOs:282-286. In some embodiments, the modified Fc polypeptide has at least 70% identity, at least 75% identity, at least 80% identity, at least 85% identity, at least 90% identity, or at least 95% identity to SEQ ID NOs:282-286. In some embodiments, the modified Fc polypeptide comprises the amino acid sequence of any one of SEQ ID NOs:282-286. In other embodiments, the modified Fc polypeptide comprises the amino acid sequence of any one of SEQ ID NOs:282-286, but in which one, two, or three amino acids are substituted.

In some embodiments, a modified Fc polypeptide that specifically binds to TfR comprises at least two, three, four, five, six, seven, eight, nine, or ten substitutions at positions 266, 267, 268, 269, 270, 271, 295, 297, 298, and 299, according to the EU numbering scheme. Illustrative modified Fc polypeptides are provided in SEQ ID NOs:287-291. In some embodiments, the modified Fc polypeptide comprises Pro at position 270, Glu at position 295, and/or Tyr at position 297. In some embodiments, the modified Fc polypeptide comprises at least one substitution at a position as follows: Pro, Phe, Ala, Met, or Asp at position 266; Gln, Pro, Arg, Lys, Ala, Ile, Leu, Glu, Asp, or Tyr at position 267; Thr, Ser, Gly, Met, Val, Phe, Trp, or Leu at position 268; Pro, Val, Ala, Thr, or Asp at position 269; Pro, Val, or Phe at position 270; Trp, Gln, Thr, or Glu at position 271; Glu, Val, Thr, Leu, or Trp at position 295; Tyr, His, Val, or Asp at position 297; Thr, His, Gln, Arg, Asn, or Val at position 298; or Tyr, Asn, Asp, Ser, or Pro at position 299. In some embodiments, two, three, four, five, six, seven, eight, nine, or all ten of positions 266, 267, 268, 269, 270, 271, 295, 297, 298, and 299 have a substitution as specified in this paragraph. In some embodiments, a modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Pro, Phe, or Ala at position 266; Gln, Pro, Arg, Lys, Ala, or Ile at position 267; Thr, Ser, Gly, Met, Val, Phe, or Trp at position 268; Pro, Val, or Ala at position 269; Pro at position 270; Trp or Gln at position 271; Glu at position 295; Tyr at position 297; Thr, His, or Gln at position 298; and/or Tyr, Asn, Asp, or Ser at position 299.

In some embodiments, the modified Fc polypeptide comprises Met at position 266; Leu or Glu at position 267; Trp at position 268; Pro at position 269; Val at position 270; Thr at position 271; Val or Thr at position 295; His at position 197; His, Arg, or Asn at position 198; and/or Pro at position 299.

In some embodiments, the modified Fc polypeptide comprises Asp at position 266; Asp at position 267; Leu at position 268; Thr at position 269; Phe at position 270; Gln at position 271; Val or Leu at position 295; Val at position 297; Thr at position 298; and/or Pro at position 299.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOs:287-291. In some embodiments, the modified Fc polypeptide has at least 70% identity, at least 75% identity, at least 80% identity, at least 85% identity, at least 90% identity, or at least 95% identity to SEQ ID NOs:287-291. In some embodiments, the modified Fc polypeptide comprises the amino acid sequence of any one of SEQ ID NOs:287-291. In other embodiments, the modified Fc polypeptide comprises the amino acid sequence of any one of SEQ ID NOs:287-291, but in which one, two, or three amino acids are substituted.

In some embodiments, a modified Fc polypeptide that specifically binds to TfR comprises at least two, three, four, five, six, seven, eight, nine, or ten substitutions at positions 268, 269, 270, 271, 272, 292, 293, 294, and 300, according to the EU numbering scheme. Illustrative modified Fc polypeptides are provided in SEQ ID NOs:292-296. In some embodiments, the modified Fc polypeptide comprises at least one substitution at a position as follows: Val or Asp at position 268; Pro, Met, or Asp at position 269; Pro or Trp at position 270; Arg, Trp, Glu, or Thr at position 271; Met, Tyr, or Trp at position 272; Leu or Trp at position 292; Thr, Val, Ile, or Lys at position 293; Ser, Lys, Ala, or Leu at position 294; His, Leu, or Pro at position 296; or Val or Trp at position 300. In some embodiments, two, three, four, five, six, seven, eight, nine, or all ten of positions 268, 269, 270, 271, 272, 292, 293, 294, and 300 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises Val at position 268; Pro at position 269; Pro at position 270; Arg or Trp at position 271; Met at position 272; Leu at position 292; Thr at position 293; Ser at position 294; His at position 296; and/or Val at position 300.

In some embodiments, the modified Fc polypeptide comprises Asp at position 268; Met or Asp at position 269; Trp at position 270; Glu or Thr at position 271; Tyr or Trp at position 272; Trp at position 292; Val, Ile, or Lys at position 293; Lys, Ala, or Leu at position 294; Leu or Pro at position 296; and/or Trp at position 300.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOs:292-296. In some embodiments, the modified Fc polypeptide has at least 70% identity, at least 75% identity, at least 80% identity, at least 85% identity, at least 90% identity, or at least 95% identity to SEQ ID NOs:292-296. In some embodiments, the modified Fc polypeptide comprises the amino acid sequence of any one of SEQ ID NOs:292-296. In other embodiments, the modified Fc polypeptide comprises the amino acid sequence of any one of SEQ ID NOs:292-296, but in which one, two, or three amino acids are substituted.

In some embodiments, a modified Fc polypeptide that specifically binds to TfR has at least two, three, four, five, six, seven, eight, nine, or ten substitutions at positions 272, 274, 276, 322, 324, 326, 329, 330, and 331, according to the EU numbering scheme. Illustrative modified Fc polypeptides are provided in SEQ ID NOs:297-301. In some embodiments, the modified Fc polypeptide comprises Trp at position 330. In some embodiments, the modified Fc polypeptide comprises at least one substitution at a position as follows: Trp, Val, Ile, or Ala at position 272; Trp or Gly at position 274; Tyr, Arg, or Glu at position 276; Ser, Arg, or Gln at position 322; Val, Ser, or Phe at position 324; Ile, Ser, or Trp at position 326; Trp, Thr, Ser, Arg, or Asp at position 329; Trp at position 330; or Ser, Lys, Arg, or Val at position 331. In some embodiments, two, three, four, five, six, seven, eight, or all nine of positions 272, 274, 276, 322, 324, 326, 329, 330, and 331 have a substitution as specified in this paragraph. In some embodiments, the modified Fc polypeptide may comprise a conservative substitution, e.g., an amino acid in the same charge grouping, hydrophobicity grouping, side chain ring structure grouping (e.g., aromatic amino acids), or size grouping, and/or polar or non-polar grouping, of a specified amino acid at one or more of the positions in the set.

In some embodiments, the modified Fc polypeptide comprises two, three, four, five, six, seven, eight, or nine positions selected from the following: position 272 is Trp, Val, Ile, or Ala; position 274 is Trp or Gly; position 276 is Tyr, Arg, or Glu; position 322 is Ser, Arg, or Gln; position 324 is Val, Ser, or Phe; position 326 is Ile, Ser, or Trp; position 329 is Trp, Thr, Ser, Arg, or Asp; position 330 is Trp; and position 331 is Ser, Lys, Arg, or Val. In some embodiments, the modified Fc polypeptide comprises Val or Ile at position 272; Gly at position 274; Arg at position 276; Arg at position 322; Ser at position 324; Ser at position 326; Thr, Ser, or Arg at position 329; Trp at position 330; and/or Lys or Arg at position 331.

In some embodiments, the modified Fc polypeptide has at least 70% identity, at least 75% identity, at least 80% identity, at least 85% identity, at least 90% identity, or at least 95% identity to amino acids 1-110 of any one of SEQ ID NOs:297-301. In some embodiments, the modified Fc polypeptide has at least 70% identity, at least 75% identity, at least 80% identity, at least 85% identity, at least 90% identity, or at least 95% identity to SEQ ID NOs:297-301. In some embodiments, the modified Fc polypeptide comprises the amino acid sequence of any one of SEQ ID NOs:297-301. In other embodiments, the modified Fc polypeptide comprises the amino acid sequence of any one of SEQ ID NOs:297-301, but in which one, two, or three amino acids are substituted.

X. ADDITIONAL FC POLYPEPTIDE MUTATIONS

In some aspects, an anti-BACE1 antibody of the disclosure comprises first and optionally second Fc polypeptides that may each comprise independently selected modifications or may be a wild-type Fc polypeptide, e.g., a human IgG1 Fc polypeptide. In some embodiments, one or both Fc polypeptides contains one or more modifications that confer binding to a blood-brain barrier (BBB) receptor, e.g., transferrin receptor (TfR). Non-limiting examples of other mutations that can be introduced into one or both Fc polypeptides include, e.g., mutations to increase serum stability or serum half-life, to modulate effector function, to influence glycosylation, to reduce immunogenicity in humans, and/or to provide for knob and hole heterodimerization of the Fc polypeptides.

In some embodiments, one or more Fc polypeptides (e.g., a first and optionally a second Fc polypeptide) has an amino acid sequence identity of at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% to a corresponding wild-type Fc polypeptide (e.g., a human IgG1, IgG2, IgG3, or IgG4 Fc polypeptide).

In some embodiments, the Fc polypeptides include knob and hole mutations to promote heterodimer formation and hinder homodimer formation. Generally, the modifications introduce a protuberance ("knob") at the interface of a first polypeptide and a corresponding cavity ("hole") in the interface of a second polypeptide, such that the protuberance can be positioned in the cavity so as to promote heterodimer formation and thus hinder homodimer formation. Protuberances are constructed by replacing small amino acid side chains from the interface of the first polypeptide with larger side chains (e.g., tyrosine or tryptophan). Compensatory cavities of identical or similar size to the protuberances are created in the interface of the second polypeptide by replacing large amino acid side chains with smaller ones (e.g., alanine or threonine). In some embodiments, such additional mutations are at a position in the Fc polypeptide that does not have a negative effect on binding of the polypeptide to a BBB receptor, e.g., TfR.

In one illustrative embodiment of a knob and hole approach for dimerization, position 366 (numbered according to the EU numbering scheme) of one of the Fc polypeptides comprises a tryptophan in place of a native threonine. The other Fc polypeptide in the dimer has a valine at position 407 (numbered according to the EU numbering scheme) in place of the native tyrosine. The other Fc polypeptide may further comprise a substitution in which the native threonine at position 366 (numbered according to the EU numbering scheme) is substituted with a serine and a native leucine at position 368 (numbered according to the EU numbering scheme) is substituted with an alanine. Thus, one of the Fc polypeptides of has the T366W knob mutation and the other Fc polypeptide has the Y407V mutation, which is typically accompanied by the T366S and L368A hole mutations.

In some embodiments, modifications to enhance serum stability or serum half-life may be introduced. For example, in some embodiments, one or both Fc polypeptides may comprise a tyrosine at position 252, a threonine at position 254, and a glutamic acid at position 256, as numbered according to the EU numbering scheme. Thus, one or both Fc polypeptides may have M252Y, S254T, and T256E substitutions. Alternatively, one or both Fc polypeptides may have M428L and N434S substitutions. Alternatively, one or both Fc polypeptides may have an N434S or N434A substitution.

In some embodiments, one or both Fc polypeptides may comprise modifications that reduce effector function, i.e., having a reduced ability to induce certain biological functions upon binding to an Fc receptor expressed on an effector cell that mediates the effector function. Examples of antibody effector functions include, but are not limited to, C1q binding and complement dependent cytotoxicity (CDC), Fc receptor binding, antibody-dependent cell-mediated cytotoxicity (ADCC), antibody-dependent cell-mediated phagocytosis (ADCP), down-regulation of cell surface receptors (e.g., B cell receptor), and B-cell activation. Effector functions may vary with the antibody class. For example, native human IgG1 and IgG3 antibodies can elicit ADCC and CDC activities upon binding to an appropriate Fc receptor present on an immune system cell; and native human IgG1, IgG2, IgG3, and IgG4 can elicit ADCP functions upon binding to the appropriate Fc receptor present on an immune cell.

In some embodiments, one or both Fc polypeptides may also be engineered to contain other modifications for heterodimerization, e.g., electrostatic engineering of contact residues within a CH3-CH3 interface that are naturally charged or hydrophobic patch modifications.

In some embodiments, one or both Fc polypeptides may include additional modifications that modulate effector function.

In some embodiments, one or both Fc polypeptides may comprise modifications that reduce or eliminate effector function. Illustrative Fc polypeptide mutations that reduce effector function include, but are not limited to, substitutions in a CH2 domain, e.g., at positions 234 and 235, according to the EU numbering scheme. For example, in some embodiments, one or both Fc polypeptides can comprise alanine residues at positions 234 and 235. Thus, one or both Fc polypeptides may have L234A and L235A (LALA) substitutions.

Additional Fc polypeptide mutations that modulate an effector function include, but are not limited to, the following: position 329 may have a mutation in which proline is substituted with a glycine or arginine or an amino acid residue large enough to destroy the Fc/Fcγ receptor interface that is formed between proline 329 of the Fc and tryptophan residues Trp 87 and Trp 110 of FcγRIII. Additional illustrative substitutions include S228P, E233P, L235E, N297A, N297D, and P331S, according to the EU numbering scheme. Multiple substitutions may also be present, e.g., L234A and L235A of a human IgG1 Fc region; L234A, L235A, and P329G of a human IgG1 Fc region; S228P and L235E of a human IgG4 Fc region; L234A and G237A of a human IgG1 Fc region; L234A, L235A, and G237A of a human IgG1 Fc region; V234A and G237A of a human IgG2 Fc region; L235A, G237A, and E318A of an human IgG4 Fc region; and S228P and L236E of a human IgG4 Fc region, according to the EU numbering scheme. In some embodiments, one or both Fc polypeptides may have one or more amino acid substitutions that modulate ADCC, e.g., substitutions at positions 298, 333, and/or 334, according to the EU numbering scheme.

Illustrative Fc Polypeptides Comprising Additional Mutations

By way of non-limiting example, one or both Fc polypeptides present in an anti-BACE1 antibody of the disclosure may comprise additional mutations including a knob mutation (e.g., T366W as numbered according to the EU numbering scheme), hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), and/or mutations that increase serum stability or serum half-life (e.g., (i) M252Y, S254T, and T256E as numbered according to the EU numbering scheme, or (ii) N434S with or without M428L as numbered with reference to EU numbering).

In some embodiments, an Fc polypeptide may have a knob mutation (e.g., T366W as numbered according to the EU numbering scheme) and at least 85% identity, at least 90% identity, or at least 95% identity to the sequence of any one of SEQ ID NOs:183-268, 277-302, and 471-477. In some embodiments, an Fc polypeptide having the sequence of any one of SEQ ID NOs:183-268, 277-302, and 471-477 may be modified to have a knob mutation.

In some embodiments, an Fc polypeptide may have a knob mutation (e.g., T366W as numbered according to the EU numbering scheme), mutations that modulate effector function (e.g., L234A, L235A, and/or P329G (e.g., L234A and L235A) as numbered according to the EU numbering scheme), and at least 85% identity, at least 90% identity, or at least 95% identity to the sequence of any one of SEQ ID NOs:183-268 277-302, and 471-477. In some embodiments, an Fc polypeptide having the sequence of any one of SEQ ID NOs:183-268, 277-302, and 471-477 may be modified to have a knob mutation and mutations that modulate effector function.

In some embodiments, an Fc polypeptide may have a knob mutation (e.g., T366W as numbered according to the EU numbering scheme), mutations that increase serum stability or serum half-life (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOs:183-268 277-302, and 471-477. In some embodiments, an Fc polypeptide having the sequence of any one of SEQ ID NOs:183-268 277-302, and 471-477 may be modified to have a knob mutation and mutations that increase serum stability or serum half-life.

In some embodiments, an Fc polypeptide may have a knob mutation (e.g., T366W as numbered according to the EU numbering scheme), mutations that modulate effector function (e.g., L234A, L235A, and/or P329G (e.g., L234A and L235A) as numbered according to the EU numbering scheme), mutations that increase serum stability or serum half-life (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOs:183-268 277-302, and 471-477. In some embodiments, an Fc polypeptide having the sequence of any one of SEQ ID NOs:183-268 277-302, and 471-477 may be modified to have a knob mutation, mutations that modulate effector function, and mutations that increase serum stability or serum half-life.

In some embodiments, an Fc polypeptide may have hole mutations (e.g., T366S, L368A, and Y407V as numbered according to the EU numbering scheme) and at least 85% identity, at least 90% identity, or at least 95% identity to the sequence of any one of SEQ ID NOs:183-268, 277-302, and 471-477. In some embodiments, an Fc polypeptide having the sequence of any one of SEQ ID NOs:183-268, 277-302, and 471-477 may be modified to have hole mutations.

In some embodiments, an Fc polypeptide may have hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), and at least 85% identity, at least 90% identity, or at least 95% identity to the sequence of any one of SEQ ID NOs:183-268, 277-302, and 471-477. In some embodiments, an Fc polypeptide having the sequence of any one of SEQ ID NOs:183-268, 277-302, and 471-477 may be modified to have hole mutations and mutations that modulate effector function.

In some embodiments, an Fc polypeptide may have hole mutations (e.g., T366S, L368A, and Y407V as numbered according to the EU numbering scheme), mutations that increase serum stability or serum half-life (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOs:183-268, 277-302, and 471-477. In some embodiments, an Fc polypeptide having the sequence of any one of SEQ ID NOs: 183-268, 277-302, and 471-477 may be modified to have hole mutations and mutations that increase serum stability or serum half-life.

In some embodiments, an Fc polypeptide may have hole mutations (e.g., T366S, L368A, and Y407V as numbered according to the EU numbering scheme), mutations that modulate effector function (e.g., L234A, L235A, and/or P329G (e.g., L234A and L235A) as numbered according to the EU numbering scheme), mutations that increase serum stability or serum half-life (e.g., (i) M252Y, S254T, and T256E as numbered according to the EU numbering scheme, or (ii) N434S with or without M428L as numbered with reference to EU numbering), and at least 85% identity, at least 90% identity, or at least 95% identity to the sequence of any one of SEQ ID NOs:183-268, 277-302, and 471-477. In some embodiments, an Fc polypeptide having the sequence of any one of SEQ ID NOs:183-268, 277-302, and 471-477 may be modified to have hole mutations, mutations that modulate effector function, and mutations that increase serum stability or serum half-life.

XI. THERAPEUTIC METHODS USING ANTI-BACE1 ANTIBODIES

In another aspect, methods for the use of anti-BACE1 antibodies as described herein are provided. In some embodiments, an anti-BACE1 antibody as described above is used in the practice of the methods described herein.

In some embodiments, methods of inhibiting or reducing the production and/or aggregation of amyloid-β (Aβ) peptides are provided. In some embodiments, methods of inhibiting or reducing the production of an Aβ peptide are provided. In some embodiments, methods of inhibiting or reducing the aggregation of Aβ peptides are provided. In some embodiments, methods of inhibiting or reducing the production and aggregation of Aβ peptides are provided. In some embodiments, the method comprises inhibiting or reducing the production and/or aggregation of Aβ peptides in a subject, e.g., in a brain of a subject. In some embodiments, the method comprises administering to the subject an anti-BACE1 antibody or antigen-binding portion thereof as described herein, a pharmaceutical composition comprising an anti-BACE1 antibody as described herein, or a multispecific (e.g., bispecific) antibody comprising an anti-BACE1 antibody as described herein.

In some embodiments, the subject is an individual having a neurodegenerative disease. In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

In some embodiments, inhibiting or reducing the formation and/or aggregation of amyloid-β peptides slows the progression of symptoms of a neurodegenerative disease (e.g., in a subject). In some embodiments, inhibiting or reducing the formation and/or aggregation of amyloid-β peptides causes the reversal of symptoms of a neurodegenerative disease. As non-limiting examples, symptoms of a neurodegenerative disease include memory deficits, cognitive deficits, motor deficits, sensory deficits, and speech deficits.

In some embodiments, methods of preventing, reducing, or inhibiting the formation of amyloid plaques are provided. In some embodiments, the method comprises preventing, reducing, or inhibiting the formation of amyloid plaques in a subject, e.g., in a brain of a subject. In some embodiments, the method comprises administering to the subject an anti-BACE1 antibody or antigen-binding portion thereof as described herein, a pharmaceutical composition comprising an anti-BACE1 antibody as described herein, or a multispecific (e.g., bispecific) antibody comprising an anti-BACE1 antibody as described herein.

In some embodiments, the subject is an individual having a neurodegenerative disease. In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia. In some embodiments, the neurodegenerative disease is Alzheimer's disease.

In some embodiments, preventing, reducing, or inhibiting the formation of amyloid plaques slows the progression of symptoms of a neurodegenerative disease (e.g., in a subject). In some embodiments, preventing, reducing, or inhibiting the formation of amyloid plaques causes the reversal of symptoms of a neurodegenerative disease. As non-limiting examples, symptoms of a neurodegenerative disease include memory deficits, cognitive deficits, motor deficits, sensory deficits, and speech deficits.

In some embodiments, methods of treating a neurodegenerative disease (e.g., in a subject such as a human subject)

are provided. In some embodiments, the method comprises administering to the subject an anti-BACE1 antibody or antigen-binding portion thereof as described herein, a pharmaceutical composition comprising an anti-BACE1 antibody as described herein, or a multispecific (e.g., bispecific) antibody comprising an anti-BACE1 antibody as described herein.

In some embodiments, the neurodegenerative disease is selected from the group consisting of Alzheimer's disease, primary age-related tauopathy, progressive supranuclear palsy (PSP), frontotemporal dementia, frontotemporal dementia with parkinsonism linked to chromosome 17, argyrophilic grain dementia, amyotrophic lateral sclerosis/parkinsonism-dementia complex of Guam, corticobasal degeneration, chronic traumatic encephalopathy, Creutzfeldt-Jakob disease, dementia pugilistica, diffuse neurofibrillary tangles with calcification, Down's syndrome, familial British dementia, familial Danish dementia, Gerstmann-Straussler-Scheinker disease, globular glial tauopathy, Guadeloupean parkinsonism with dementia, Guadelopean PSP, Hallevorden-Spatz disease, inclusion-body myositis, multiple system atrophy, Huntington's disease, myotonic dystrophy, neurofibrillary tangle-predominant dementia, Niemann-Pick disease type C, pallido-ponto-nigral degeneration, Parkinson disease, Pick's disease, postencephalitic parkinsonism, prion protein cerebral amyloid angiopathy, progressive subcortical gliosis, subacute sclerosing panencephalitis, and tangle only dementia.

In some embodiments, an anti-BACE1 antibody (or antigen-binding portion thereof, multispecific antibody, or pharmaceutical composition) as described herein is used in treating Alzheimer's disease. In some embodiments, the anti-BACE1 antibody is used in treating prodromal Alzheimer's disease. In some embodiments, the anti-BACE1 antibody is used in treating mild Alzheimer's disease (an early-stage form of the disease). In some embodiments, the anti-BACE1 antibody is used in treating moderate Alzheimer's disease (a middle-stage form of the disease). In some embodiments, the anti-BACE1 antibody is used in treating severe Alzheimer's disease (a late-stage form of the disease). In some embodiments, the anti-BACE1 antibody is used in treating early-onset Alzheimer's disease. In some embodiments, the anti-BACE1 antibody is used in treating late-onset Alzheimer's disease.

In some embodiments, the subject to be treated is a human, e.g., a human adult or a human child.

In some embodiments, treating the subject slows the progression of symptoms of a neurodegenerative disease. In some embodiments treating the subject causes the reversal of symptoms of a neurodegenerative disease. As non-limiting examples, symptoms of a neurodegenerative disease include memory deficits, cognitive deficits, motor deficits, sensory deficits, and speech deficits.

In some embodiments, the method further comprises administering to the subject one or more other therapeutic agents. In some embodiments, the method comprises administering to the subject an agent, e.g., an antibody, that binds to amyloid-β (Aβ) peptides or prevents the aggregation of Aβ peptides. In some embodiments, the method comprises administering to the subject an antibody against Aβ, including but not limited to aducanumab, bapineuzumab, solanezumab, and gantenerumab. In some embodiments, the method comprises administering to the subject an alpha-synuclein antibody. In some embodiments, the method comprises administering to the subject a neuroprotective agent. In some embodiments, the neuroprotective agent is an anticholinergic agent, a dopaminergic agent, a glutamatergic agent, a histone deacetylase (HDAC) inhibitor, a cannabinoid, a caspase inhibitor, melatonin, an anti-inflammatory agent, a hormone (e.g., estrogen or progesterone), or a vitamin. In some embodiments, the method comprises administering to the subject an agent for use in treating a cognitive or behavioral symptom of a neurodegenerative disease (e.g., an antidepressant, a dopamine agonist, or an anti-psychotic).

In some embodiments, an anti-BACE1 antibody is administered to a subject at a therapeutically effective amount or dose. Illustrative dosages include a dose range of about 1 mg/kg to about 100 mg/kg, or about 10 mg/kg to about 50 mg/kg. The dosages, however, may be varied according to several factors, including the dose frequency, the chosen route of administration, the formulation of the composition, patient response, the severity of the condition, the subject's weight, and the judgment of the prescribing physician. The dosage can be increased or decreased over time, as required by an individual patient. In certain instances, a patient initially is given a low dose, which is then increased to an efficacious dosage tolerable to the patient.

The route of administration of an anti-BACE1 antibody (or antigen-binding portion thereof, multispecific antibody, or pharmaceutical composition) as described herein can be oral, intraperitoneal, transdermal, subcutaneous, intravenous, intramuscular, intrathecal, inhalational, topical, intralesional, rectal, intrabronchial, nasal, transmucosal, intestinal, intraocular, ocular or otic delivery, or any other methods known in the art. In some embodiments, the antibody is administered orally, intravenously, or intraperitoneally.

Co-administered agents (e.g., the anti-BACE1 antibody and another therapeutic agent) can be administered together or separately, simultaneously or at different times. When administered, the therapeutic agents independently can be administered once, twice, three, four times daily or more or less often, as needed. In some embodiments, the administered therapeutic agents are administered once daily. In some embodiments, the administered therapeutic agents are administered at the same time or times, for instance as an admixture.

In some embodiments, the anti-BACE1 antibody and another therapeutic agent are administered concurrently. In some embodiments, the anti-BACE1 antibody and another therapeutic agent are administered sequentially. For example, in some embodiments an anti-BACE1 antibody is administered first, prior to administering another therapeutic agent. In some embodiments, the other therapeutic agent is administered first, prior to administering an anti-BACE1 antibody.

In some embodiments, the anti-BACE1 antibody (and optionally another therapeutic agent) is administered to the subject over an extended period of time.

XII. PHARMACEUTICAL COMPOSITIONS AND KITS

In another aspect, pharmaceutical compositions and kits comprising an antibody that specifically binds to a BACE1 protein (e.g., human BACE1 protein) described herein are provided. In some embodiments, the pharmaceutical compositions and kits are for use in inhibiting or reducing the production and/or aggregation of amyloid-β (Aβ) peptides, e.g., in a brain of a subject. In some embodiments, the pharmaceutical compositions and kits are for use in preventing, reducing, or inhibiting the formation of amyloid plaques, e.g., in a brain of a subject. In some embodiments, the pharmaceutical compositions and kits are for use in treating a neurodegenerative disease, such as Alzheimer's disease or another neurodegenerative disease described herein.

Pharmaceutical Compositions

In some embodiments, pharmaceutical compositions comprising an anti-BACE1 antibody are provided. In some embodiments, the anti-BACE1 antibody is an antibody (or antigen-binding portion thereof or multispecific antibody) as described above.

In some embodiments, a pharmaceutical composition comprises an anti-BACE1 antibody as described herein and further comprises one or more pharmaceutically acceptable carriers and/or excipients. A pharmaceutically acceptable carrier includes any solvents, dispersion media, or coatings that are physiologically compatible and that do not interfere with or otherwise inhibit the activity of the active agent.

In some embodiments, the carrier is suitable for intravenous, intramuscular, oral, intraperitoneal, intraocular, intrathecal, transdermal, topical, or subcutaneous administration. Pharmaceutically acceptable carriers can contain one or more physiologically acceptable compound(s) that act, for example, to stabilize the composition or to increase or decrease the absorption of the active agent(s). Physiologically acceptable compounds can include, for example, carbohydrates, such as glucose, sucrose, or dextrans, antioxidants, such as ascorbic acid or glutathione, chelating agents, low molecular weight proteins, compositions that reduce the clearance or hydrolysis of the active agents, or excipients or other stabilizers and/or buffers. Other pharmaceutically acceptable carriers and their formulations are well-known in the art.

The pharmaceutical compositions described herein can be manufactured, e.g., by means of conventional mixing, dissolving, granulating, dragee-making, emulsifying, encapsulating, entrapping, or lyophilizing processes. The following methods and excipients are exemplary.

For oral administration, an anti-BACE1 antibody can be formulated by combining it with pharmaceutically acceptable carriers that are well known in the art. Such carriers enable the antibody to be formulated as tablets, pills, dragees, capsules, emulsions, lipophilic and hydrophilic suspensions, liquids, gels, syrups, slurries, suspensions and the like, for oral ingestion by a patient to be treated. Pharmaceutical preparations for oral use can be obtained by mixing the antibody with a solid excipient, optionally grinding a resulting mixture, and processing the mixture of granules, after adding suitable auxiliaries, if desired, to obtain tablets or dragee cores. Suitable excipients include, for example, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents can be added, such as a cross-linked polyvinyl pyrrolidone, agar, or alginic acid or a salt thereof such as sodium alginate.

An anti-BACE1 antibody can be formulated for parenteral administration by injection, e.g., by bolus injection or continuous infusion. For injection, the antibody can be formulated into preparations by dissolving, suspending, or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives. In some embodiments, antibodies can be formulated in aqueous solutions such as physiologically compatible buffers, non-limiting examples of which include Hanks's solution, Ringer's solution, and physiological saline buffer. Formulations for injection can be presented in unit dosage form, e.g., in ampules or in multi-dose containers, with an added preservative. The compositions can take such forms as suspensions, solutions or emulsions in oily or aqueous vehicles, and can contain formulatory agents such as suspending, stabilizing and/or dispersing agents.

In some embodiments, an anti-BACE1 antibody is prepared for delivery in a sustained-release, controlled release, extended-release, timed-release, or delayed-release formulation, for example, in semi-permeable matrices of solid hydrophobic polymers containing the active agent. Various types of sustained-release materials have been established and are well known by those skilled in the art. Current extended-release formulations include film-coated tablets, multiparticulate or pellet systems, matrix technologies using hydrophilic or lipophilic materials and wax-based tablets with pore-forming excipients. Usually, sustained release formulations can be prepared using naturally occurring or synthetic polymers, for instance, polymeric vinyl pyrrolidones, such as polyvinyl pyrrolidone (PVP); carboxyvinyl hydrophilic polymers; hydrophobic and/or hydrophilic hydrocolloids, such as methylcellulose, ethylcellulose, hydroxypropylcellulose, and hydroxypropylmethylcellulose; and carboxypolymethylene.

Typically, a pharmaceutical composition for use in in vivo administration is sterile. Sterilization can be accomplished according to methods known in the art, e.g., heat sterilization, steam sterilization, sterile filtration, or irradiation.

Dosages and desired drug concentration of pharmaceutical compositions of the disclosure may vary depending on the particular use envisioned. Suitable dosages are also described herein.

Kits

In some embodiments, kits comprising an anti-BACE1 antibody (or antigen-binding portion thereof or multispecific antibody) as described herein (e.g., as described above), or a pharmaceutical composition described herein, are provided. In some embodiments, the kits are for use in are for use in inhibiting or reducing the production and/or aggregation of amyloid-β (Aβ) peptides, e.g., in a brain of a subject. In some embodiments, the kits are for use in preventing, reducing, or inhibiting the formation of amyloid plaques, e.g., in a brain of a subject. In some embodiments, the kits are for use in treating a neurodegenerative disease, such as Alzheimer's disease or another neurodegenerative disease described herein.

In some embodiments, the kit further comprises one or more additional therapeutic agents. For example, in some embodiments, the kit comprises an anti-BACE1 antibody as described herein and further comprises one or more additional therapeutic agents for use in the treatment of a neurodegenerative disease. In some embodiments, the therapeutic agent is an agent for use in treating a cognitive or behavioral symptom of a neurodegenerative disease (e.g., an antidepressant, a dopamine agonist, or an anti-psychotic). In some embodiments, the therapeutic agent is a neuroprotective agent (e.g., an anticholinergic agent, a dopaminergic agent, a glutamatergic agent, a histone deacetylase (HDAC) inhibitor, a cannabinoid, a caspase inhibitor, melatonin, an anti-inflammatory agent, a hormone (e.g., estrogen or progesterone), or a vitamin). In some embodiments, the therapeutic agent is an agent, e.g., an antibody, that binds to amyloid-β peptides or prevents the aggregation of amyloid-β peptides.

In some embodiments, the kit further comprises instructional materials containing directions (i.e., protocols) for the practice of the methods described herein (e.g., instructions for using the kit for treating a neurodegenerative disease). While the instructional materials typically comprise written or printed materials they are not limited to such. Any medium capable of storing such instructions and communicating them to an end user is contemplated by this disclosure. Such media include, but are not limited to electronic storage media (e.g., magnetic discs, tapes, cartridges, chips), optical media (e.g., CD-ROM), and the like. Such media may include addresses to internet sites that provide such instructional materials.

XIII. EXAMPLES

The present disclosure will be described in greater detail by way of specific examples. The following examples are offered for illustrative purposes only, and are not intended to limit the disclosure in any manner.

Example 1. Generation and Characterization of Anti-BACE1 Antibodies

This example describes the generation, screening, and characterization of anti-beta-secretase 1 (BACE1) antibodies of the present disclosure.

Immunization of BACE1 Knockout Mice

BACE1 knockout mice were obtained from Jackson Laboratory (JAX). BACE1 extracellular domain was obtained from R&D Systems (Cat #931-AS). Stable cell lines overexpressing BACE1 protein were generated with full-length BACE1 (SEQ ID NO:305) cloned into a pcDNA3.1 vector using standard methods that will be familiar to those of skill in the art. All adjuvants were purchased from Sigma. Two cohorts of five mice each were immunized. Immunization schedules for the two cohorts are shown in Tables 1 and 2. Bleeds were taken on days 23 and 51. Three days after final boost, two mice from each group were sacrificed, and inguinal and popliteal lymph nodes were harvested (i.e., approximately 30 million cells per mouse). Single cell suspensions were prepared by passing the lymph nodes through a 70-micron cell strainer, and the cells were pelleted, flash frozen in liquid nitrogen, and stored at −80° C. until processing.

TABLE 1

Immunization schedule for mouse cohort 1

| Day | Immunogen | Amount | Adjuvant | Route |
|---|---|---|---|---|
| 1 | BACE1 | 10 µg | Ribi | hock |
| 4 | BACE1 | 5 µg | Ribi | hock |
| 8 | BACE1 | 5 µg | Ribi | hock |
| 11 | BACE1 | 3 µg | Ribi | hock |
| 14 | BACE1 | 3 µg | Ribi | hock |
| 17 | BACE1 | 5 µg | Ribi | hock |
| 20 | BACE1 | 5 µg | Ribi | hock |
| 44 | BACE1 | 3 µg | CpG | footpad |
| 51 | BACE1 | 3 µg | CpG | footpad |
| 67 | BACE1 | 5 µg | SAS | footpad + i.p. |

TABLE 2

Immunization schedule for mouse cohort 2

| Day | Immunogen | Amount | Adjuvant | Route |
|---|---|---|---|---|
| 1 | BACE1 | 10 µg | Ribi | hock |
| 4 | BACE1 | 5 µg | Ribi | hock |
| 8 | BACE1 | 5 µg | Ribi | hock |
| 11 | BACE1 | 3 µg | Ribi | hock |
| 14 | BACE1 | 3 µg | Ribi | hock |
| 17 | BACE1 | 5 µg | Ribi | hock |
| 20 | BACE1 | 5 µg | Ribi | hock |
| 44 | Cells (5e6) | 3 µg | Ribi | footpad |
| 47 | BACE1 | 3 µg | CpG | footpad |
| 51 | Cells (5e6) |  | Ribi | footpad |
| 54 | BACE1 | 3 µg | CpG | footpad + i.p. |

Antibody Discovery

Purification of RNA and Generation of cDNA from Lymphocytes

Cell pellets from frozen splenocytes or lymphocytes were thawed on ice and resuspended in 1 mL TRIzol™. The solution was incubated at room temperature for 5 minutes, then 0.2 mL of chloroform was added and the tubes were shaken vigorously for 15 seconds. The tubes were spun at 20,000×g for 15 minutes at 4° C. to separate the phases. The colorless aqueous phase was carefully removed leaving the white interphase and the pink chloroform phase. RNA was precipitated by addition of 0.6 mL of isopropanol, mixing by inversion, and then spinning at 20,000×g for 15 minutes at 4° C. The supernatant was discarded and the pellet was washed with 75% ethanol and dissolved in DEPC-treated water. cDNA was generated from the total RNA using SuperScript™ III reverse transcriptase (obtained from Thermo Fisher) using the manufacturer's recommended protocol for priming with oligo-dT.

Generation of Immune Phage Display Libraries

General methods for making immune phage libraries are well known to those of skill in the art and have been outlined in the literature (see, e.g., Phage Display: A Laboratory Manual by Barbas, et al., hereby incorporated by reference for all purposes). Two libraries were generated, one using lymphocytes from mice immunized with protein only and one using lymphocytes from mice immunized with protein and cells. All subsequent steps were identical for both libraries.

PCR reactions were carried out to amplify V genes for heavy or light chain variable regions using primers specific for the respective mouse germline genes. The PCR products were purified by agarose gel. VH-CH1 fragments were generated by a joining PCR reaction using the VH products and DNA for human CH1 region along with end primers. VL-CL fragments were generated by a joining PCR reaction using the VL products and DNA for the human kappa region along with end primers. The respective fragments were purified by agarose gel. A final PCR reaction was carried out to join the VH-CH1 and VL-CL fragments, and the resulting DNA encoding Fab was again purified by agarose gel, then digested with SfiI restriction enzyme. The digested Fab fragment was ligated into an SfiI-digested phagemid vector overnight at 16° C., and the ligation product was purified by ethanol precipitation. Electrocompetent TG1 *E. coli* cells (obtained from Lucigen®) were electroporated using a BTX® ECM® 630 electroporation system according to the manufacturer's suggested parameters. For each library, four to six electroporation reactions with 0.5 µg of ligation product per reaction were performed. Immediately after each electroporation reaction, the cuvettes were washed with 2 mL of recovery media (obtained from Lucigen®) and the TG1 cells were recovered at 37° C. with shaking for 1 hour. Selective media, 2YT containing 100 µg/mL carbenicillin (2YTC) was added, and the TG1 cells were grown to an $OD_{600}$ of approximately 0.5. M13K07 helper phage were added at an MOI of approximately 10 and infected at 37° C. for 30 minutes without shaking, followed by 30 minutes with shaking, and then 50 µg/mL kanamycin was added. The cells were grown overnight at 30° C. with shaking. Cultures were harvested by centrifugation at 8,000 rpm at 4° C. and the pellets were discarded. PEG/NaCl (obtained from Teknova) was added to the supernatants at a final concentration of 4% PEG. The phage were precipitated on ice for 1 hour, then spun at 8,000 rpm to pellet. The supernatants were removed, and the phage were dissolved in 40 mL PBS. The solutions were centrifuged at maximum speed for 10 minutes to remove any insoluble material, then phage were precipitated a second time from the supernatant by addition of PEG/NaCl and incubation on ice. The phage were again pelleted by centrifugation and suspended in 8 mL of PBS containing 15% glycerol, then aliquoted and frozen.

Phage Panning

Phage aliquots (0.5 mL) were thawed and mixed with 0.5 mL of 10% BSA in PBS to block. The phage were added to an aliquot of 200 µL M280-streptavidin (M280SA, Invitrogen #60210) beads and incubated at room temperature with gentle rotation for 1 hour. Meanwhile, biotinylated BACE1 extracellular domain protein (100 pmol) was added to a second aliquot of 200 M280SA beads and incubated at room temperature with gentle rotation for 30 minutes, then the beads were washed with PBS with 1% BSA (PBSA) three times, using a magnet to separate the beads between each wash. The phage solution was then separated from the negative M280SA beads using the magnet, and added to the BACE1-loaded beads. After a 1 hour incubation with gentle rotation, the beads were washed four times with PBS containing 0.1% BSA and 0.05% Tween® 20, each wash lasting 5 minutes. Bound phage were eluted from the beads using 0.1 M glycine (pH 2.7) for 30 minutes; the eluted phage solution was then neutralized with 1 M Tris (pH 7.5). The eluted phage were used to infect 10 mL TG1 *E. coli* grown to mid-log phase ($OD_{600}$ approximately 0.5) at 37° C. for 30 minutes without shaking, followed by 30 minutes with shaking. Selective media (2YTC) was added (40 mL volume), and the cultures were grown for 1-2 hours at 37° C. with shaking. At this point the cultures were at $OD_{600}$ of 0.5 or lower, and were infected with M13K07 helper phage at an MOI of approximately 10. After infection, 50 µg/mL kanamycin was added and the cultures were grown overnight at 30° C. with shaking. For the second panning round, phage were precipitated once with PEG/NaCl and concentrated 20-fold, then the same protocol as above was followed, except that more stringent washing was performed (6× PBST washes, 2 for 15 minutes, along with competition with unlabeled BACE1). After the second panning round, infected TG1 cells were spread onto 2YTCG plates (obtained from Teknova) for picking of single colonies for screening.

Screening

Generating Fabs Using Periplasmic Expression

Single colonies from the second panning round output were picked and placed into 96-well deep-well plates containing 0.5 mL of 2YTC media. The plates were sealed and grown overnight at 37° C. with shaking. To induce periplasmic Fab expression, 50 µL of the overnight culture was transferred to new 96-well deep-well plates containing 950 µL per well of 2YTC media with auto-induction supplements (obtained from EMD Millipore). The plates were sealed and grown overnight at 37° C. The plates were centrifuged at 4,000 rpm for 10 minutes to pellet the bacteria and the media was discarded. The pellets were suspended in 0.1 mL of PPB buffer (obtained from Teknova) and shaken at 10° C. and 1,000 rpm for one hour, after which 0.3 mL of water was added to each well. After an additional 30 minutes of shaking, the plates were spun at maximum speed for 10 minutes. The resulting supernatant contained soluble, crude Fab for screening.

Screening Fabs for Binding to BACE1 Extracellular Domain Protein

Half-area ELISA plates (Costar™) were coated overnight at 4° C. with 25 µL per well of 0.5 µg/mL BACE1 extracellular domain protein. The plates were washed three times with PBST using a BioTek® plate washer. The plates were then blocked for one hour at room temperature with 100 µL per well of PBSA (PBS+1% BSA). After washing three times with PBST, the periplasmically-expressed Fabs were added (25 µL per well) and the plates were incubated for one hour. The plates were subsequently washed three times with PBST, and 25 µL per well of PBSA containing a 1:5,000 dilution of HRP-conjugated rabbit anti-human kappa (Bethyl Laboratories) was added. The plates were incubated at room temperature for 30 minutes, then washed three times with PBST. The plates were developed by adding 25 µL per well of TMB substrate (obtained from Thermo Fisher) and quenched with 2N $H_2SO_4$. The signal was quantified on a BioTek® plate reader at $A_{450}$. Wells with signal greater than 5-fold over background were considered positive and the clones were re-arrayed from the primary culture for confirmation of binding (by repeat of ELISA) and testing for cell binding.

Screening Fabs for Binding to BACE1-Overexpressing Cells

BACE1-overexpressing CHO-K1 cells were harvested using a non-trypsin cell dissociation buffer and distributed in 96-well V-bottom plates in 50 uL PBSA. Fabs prepared by periplasmic expression were added to the wells (50 uL) and the plates were incubated for 1 hour at 4° C. The plates were spun and the media was dumped, then the wells were washed 2× with 100 uL PBSA. The cells were then resuspended in 100 uL PBSA containing 1 µg/mL goat anti-human-Alexa Fluor® 647 (obtained from ThermoFisher). The plates were incubated in the dark at 4° C. for 20 minutes. The plates were then spun and the media was dumped, then the wells were washed once with PBSA. The cells were resuspended in 50 uL PBSA containing 1 µg/mL DAPI and analyzed on a FACS Canto II flow cytometer. Samples with median fluorescence intensity greater than about 3-fold over background were considered positive and sequenced.

Reformatting and Expressing Selected Antibodies to Human IgG1-Kappa

Unique sequences were selected for reformatting into human IgG1 and human kappa vectors for soluble expression in CHO cells. DNA encoding the respective antibodies was subcloned into expression vectors using methods that will be familiar to one of skill in the art. The heavy and light chain CDRs from the reformatted antibodies are set forth in SEQ ID NOs:29-47, 51-72, 78-99, 129-143, 145-156, and 158-176. The heavy and light chain variable region sequences are set forth in SEQ ID NOs:1-23 and 101-122, respectively.

Furthermore, heavy chain and light chain variants to clone 2H8 were identified (SEQ ID NOs:24-28 and 123-128, respectively). The corresponding CDRs are set forth in SEQ ID NOs:48-50, 73-77, 99-100, 130, 138, 144, 146, 152, 157, 159, and 177. Antibodies were expressed in ExpiCHO cells (obtained from ThermoFisher) and purified on Protein A resin using standard methods that will be familiar to one of skill in the art. The sequences of heavy and light chain CDRs, as well as heavy and light variable regions, are set forth in Tables 9 and 10.

Characterization of Antibodies

Cellular APP Cleavage Assay

CHOK1-huAPP cells (15,000 cells/well) were plated on tissue culture-treated 96-well plates (Thermo Sci Nunclon Delta Surface) in 100 μL/well DMEM/F12 media supplemented with 10% FBS. After plating, cells recovered overnight at 37° C. with 5% $CO_2$. As shown in FIG. 1, twenty anti-BACE1 antibodies were initially screened at two concentrations (i.e., 15.6 nM and 250 nM) to select antibodies that inhibited cellular BACE1. For the subsequent treatments, antibodies and a BACE small molecule inhibitor (MK-8931) were first serially-diluted in media at 1,000 nM to 0.06 nM (4-fold dilutions) and 1 μM, respectively. The media was entirely replaced with 100 μL diluted treatment with duplicate wells for each condition. Cells were then kept at 37° C. with 5% $CO_2$ for 24 hours. Following the 24-hour treatment, the media was collected for Aβ1-40 measurement.

Figure 2:
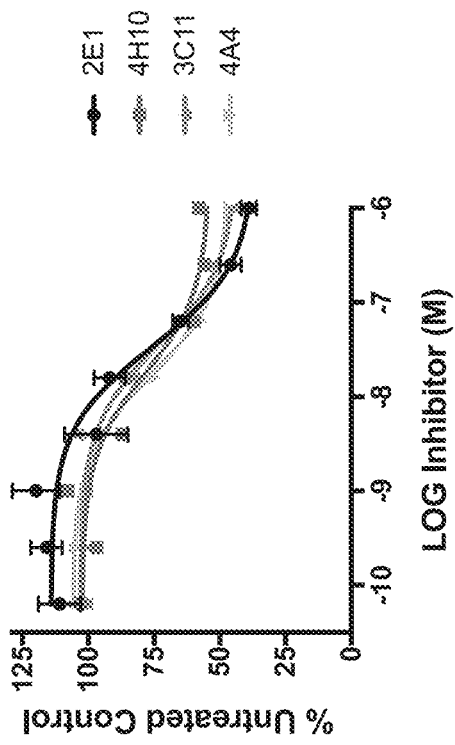
FIG. 2 shows the results of cellular APP cleavage assays in a dose-response format for anti-BACE1 antibodies that showed inhibitory activity.
Figure 2:
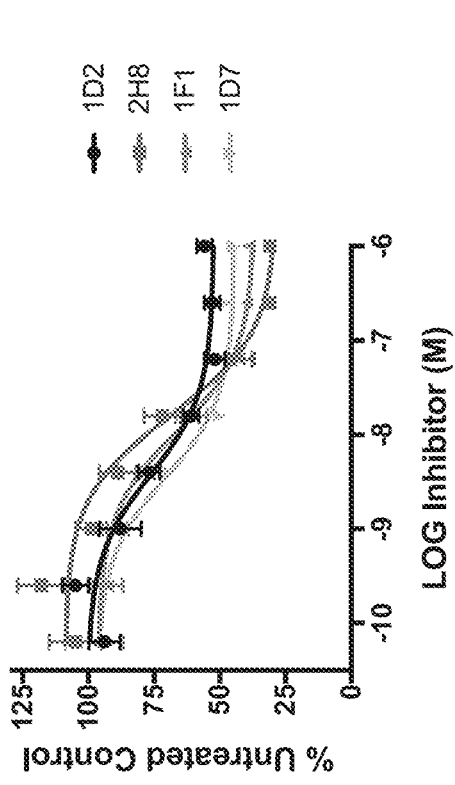

Human Aβ1-40 was measured according to the Cisbio Aβ1-40 kit instructions (Cisbio #62B40PEG). Briefly, two anti-Aβ1-40 antibodies were used in this assay: one antibody was labeled with Eu3+-Cryptate and the other with XL-665. Both antibodies were incubated with 5 μL of media in technical duplicate in a PerkinElmer OptiPlate 384-well plate for 24 hours at 4° C. The TR-FRET signal was measured using a PerkinElmer Envision plate reader and Aβ1-40 concentration was calculated from a standard curve (2,000-62.5 pg/mL) using the 665 nm/620 nm ratio. The Aβ40 signal was then normalized to the untreated controls (i.e., eight replicates per cell plate). Cell potency and efficacy data are shown in Table 3 and FIG. 2.

TABLE 3

CHO-huAPP data for anti-BACE1 antibodies

| Antibody | Cellular $IC_{50}$ (nM) | % Max Inhibition |
|---|---|---|
| 1D2 | 4 | 47 |
| 1D7 | 4 | 55 |
| 1F1 | 11 | 63 |
| 2E1 | 34 | 63 |
| 2H8 | 16 | 71 |
| 3C11 | 36 | 56 |
| 4A4 | 17 | 53 |
| 4H10 | 18 | 46 |

Figure 3:
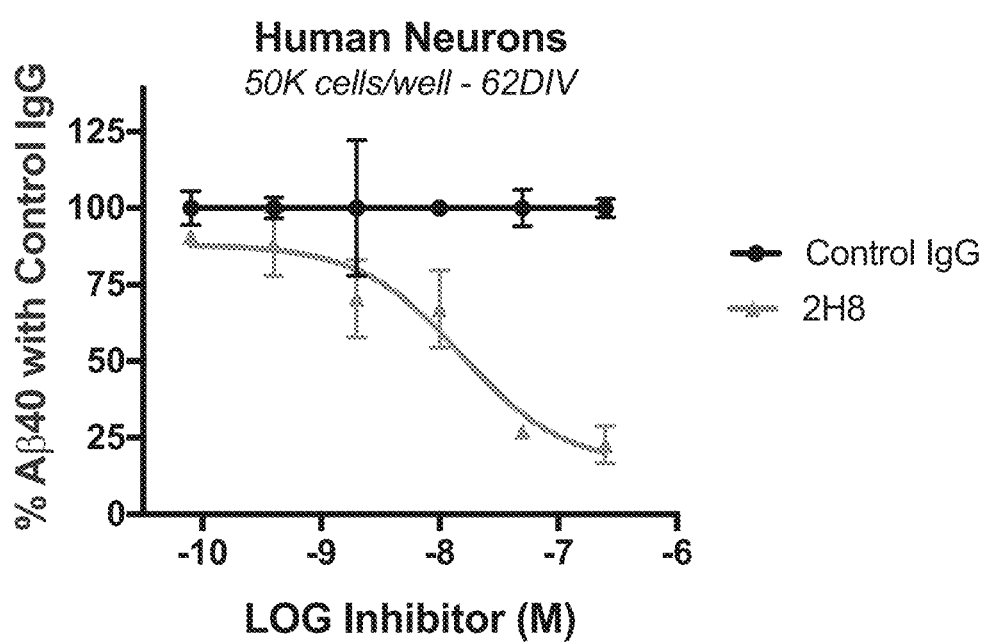
FIG. 3 shows the results of cellular APP cleavage assays with primary human neurons using the anti-BACE1 antibody 2H8 and an isotype control antibody. IC$_{50}$=15 nM. Maximum inhibition=84%.
Figure 4A:
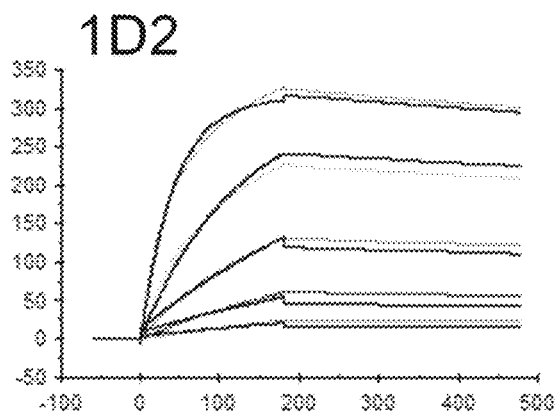
FIGS. 4A-4D shows Biacore™ sensograms for anti-BACE1 antibodies.
Figure 4B:
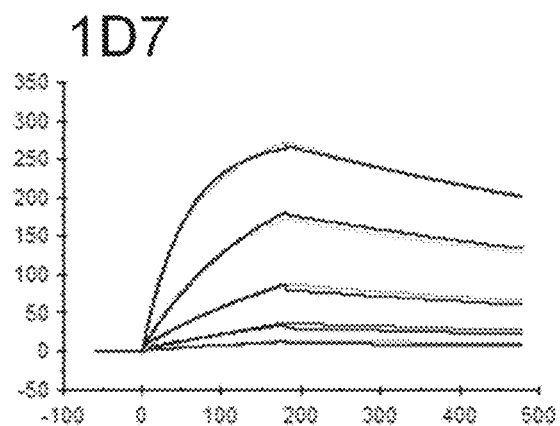
Figure 4C:
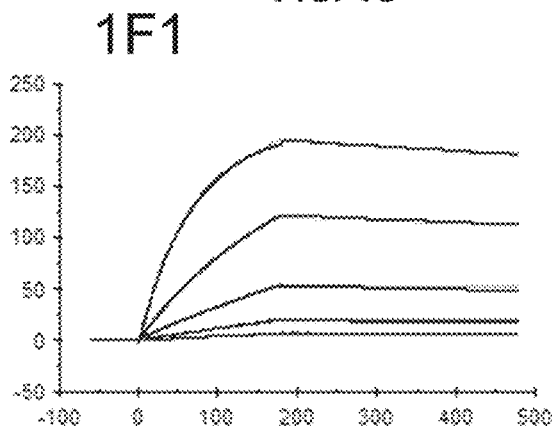
Figure 4D:
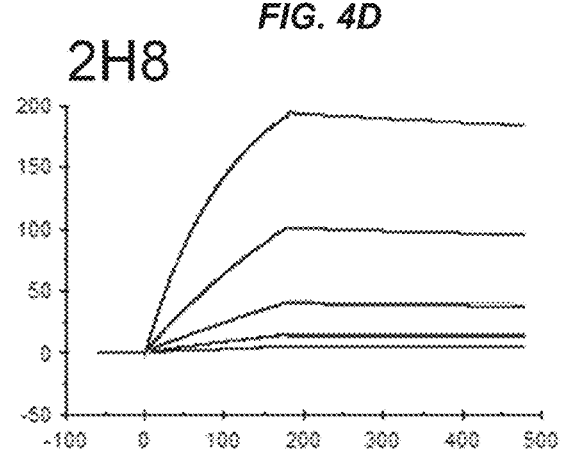

An analogous assay was run using 2H8 on human neurons. Primary human neurons (60,000 well) were plated on poly-D-lysine (PDL)-coated 96-well plates (Corning BioCoat Poly-D-Lysine Multiwell Plates, Catalog: 356640, obtained from Thermo Fisher Scientific) in 100 μL/well NbActiv4 medium (Catalog: Nb4-500, BrainBit, supplemented with 1× Penicillin-Streptomycin-Glutamine (Catalog: 10-378-016, obtained from Thermo Fisher Scientific)). Neurons were at least 47 divisions to ensure that they produced detectable levels of amyloid-β (Aβ). Neurons were treated with various antibodies. Antibodies were first diluted to 250 nM in NbActiv4 medium and then five 1:5 serial dilutions were made in NbActiv4 medium. Thus, the dose response tested the following concentrations: 250 nM, 50 nM, 10 nM, 2 nM, 0.4 nM, and 0.08 nM. Medium of neurons were entirely replaced with that containing antibodies. Neurons were then kept at 37° C. with 5% $CO_2$ for 24 hours. After 24 hours, media was collected for Aβ measurement by ELISA, as described above. In this assay, 2H8 inhibited Aβ40 formation with an $IC_{50}$ of 15 nM and maximum inhibition of 84%. Data are shown in FIG. 3

Biacore™

The affinity of chimeric IgG antibodies for recombinant BACE1 was determined by surface plasmon resonance using a Biacore™ T200 instrument. Biacore™ Series S CM5 sensor chips were immobilized with monoclonal mouse anti-human IgG (Fc) antibody (e.g., using a human antibody capture kit from GE Healthcare). 1 μg/mL of antibody was captured for 1 minute on each flow cell and serial 3-fold dilutions of recombinant BACE1 were injected at a flow rate of 30 μL/min. Each sample was analyzed with a 3-minute association and a 10-minute dissociation. After each injection, the chip was regenerated using 3M $MgCl_2$. Binding response was corrected by subtracting the RU from a flow cell capturing an irrelevant IgG at similar density. A 1:1 Langmuir model of simultaneous fitting of $k_{on}$ and $k_{off}$ was used for analysis of kinetics. Kinetics data are shown in FIG. 4 and Table 4.

TABLE 4

Kinetics data for anti-BACE1 antibodies calculated using Biacore™

| Antibody | $k_{on}$ (1/M · s) | $k_{off}$ (1/s) | $K_D$ (M) |
|---|---|---|---|
| 1D2 | 7.8 × 10$^4$ | 2.4 × 10$^{-4}$ | 3.1 × 10$^{-9}$ |
| 1D7 | 5.9 × 10$^4$ | 9.5 × 10$^{-4}$ | 1.6 × 10$^{-8}$ |
| 1F1 | 4.9 × 10$^4$ | 2.4 × 10$^{-4}$ | 5.0 × 10$^{-9}$ |
| 2E1 | 1.8 × 10$^4$ | 1.3 × 10$^{-3}$ | 7.1 × 10$^{-8}$ |
| 2H8 | 3.0 × 10$^4$ | 1.9 × 10$^{-4}$ | 6.3 × 10$^{-9}$ |
| 3C11 | 2.1 × 10$^4$ | 1.3 × 10$^{-3}$ | 6.1 × 10$^{-8}$ |
| 4A4 | 8.3 × 10$^4$ | 1.2 × 10$^{-3}$ | 1.5 × 10$^{-8}$ |
| 4H10 | 9.6 × 10$^4$ | 2.2 × 10$^{-3}$ | 2.3 × 10$^{-8}$ |

Variants of Antibody 2H8

Next, a series of variants of 2H8 was tested that had minor sequence differences in either the heavy chain (SEQ ID NOs:23-28) or light chain (SEQ ID NOs:122-128) variable regions. The affinities, maximum inhibition percentages, and $IC_{50}$ values of these antibodies are listed in Table 5.

TABLE 5

Properties of 2H8 variants

| Variant | Heavy chain | Light chain | Max. % inhibition | $IC_{50}$ (nM) | $k_{on}$ (1/M · s) | $k_{off}$ (1/s) | $K_D$ (M) |
|---|---|---|---|---|---|---|---|
| 2H8.01 | 2H8_HC | 2H8_LC | 82% | 25 | 2.14 × 10$^4$ | 3.16 × 10$^{-4}$ | 1.48 × 10$^{-8}$ |
| 2H8.02 | 2H8_HCvar2 | 2H8_LC | 81% | 42 | 2.02 × 10$^4$ | 2.65 × 10$^{-4}$ | 1.31 × 10$^{-8}$ |
| 2H8.03 | 2H8_HCvar3 | 2H8_LC | — | — | 1.61 × 10$^4$ | 2.89 × 10$^{-4}$ | 1.79 × 10$^{-8}$ |
| 2H8.04 | 2H8_HCvar4 | 2H8_LC | 82% | 26 | 2.33 × 10$^4$ | 3.62 × 10$^{-4}$ | 1.56 × 10$^{-8}$ |

TABLE 5-continued

Properties of 2H8 variants

| Variant | Heavy chain | Light chain | Max. % inhibition | IC$_{50}$ (nM) | k$_{on}$ (1/M · s) | k$_{off}$ (1/s) | K$_D$ (M) |
|---|---|---|---|---|---|---|---|
| 2H8.05 | 2H8_HCvar5 | 2H8_LC | 87% | 44 | 1.83 × 10$^4$ | 2.51 × 10$^{-4}$ | 1.37 × 10$^{-8}$ |
| 2H8.06 | 2H8_HCvar6 | 2H8_LC | — | — | 1.65 × 10$^4$ | 2.64 × 10$^{-4}$ | 1.60 × 10$^{-8}$ |
| 2H8.07 | 2H8_HC | 2H8_LCvar2 | — | — | 1.47 × 10$^4$ | 2.94 × 10$^{-4}$ | 2.00 × 10$^{-8}$ |
| 2H8.08 | 2H8_HCvar2 | 2H8_LCvar2 | — | — | 1.43 × 10$^4$ | 2.99 × 10$^{-4}$ | 2.09 × 10$^{-8}$ |
| 2H8.09 | 2H8_HCvar3 | 2H8_LCvar2 | — | — | 1.25 × 10$^4$ | 2.28 × 10$^{-4}$ | 1.83 × 10$^{-8}$ |
| 2H8.10 | 2H8_HCvar4 | 2H8_LCvar2 | — | — | 1.42 × 10$^4$ | 8.78 × 10$^{-4}$ | 6.20 × 10$^{-8}$ |
| 2H8.11 | 2H8_HCvar5 | 2H8_LCvar2 | — | — | 1.33 × 10$^4$ | 2.35 × 10$^{-4}$ | 1.77 × 10$^{-8}$ |
| 2H8.12 | 2H8_HCvar6 | 2H8_LCvar2 | — | — | 9.68 × 10$^3$ | 1.66 × 10$^{-3}$ | 1.71 × 10$^{-7}$ |
| 2H8.13 | 2H8_HC | 2H8_LCvar3 | — | — | 1.55 × 10$^4$ | 3.08 × 10$^{-4}$ | 1.98 × 10$^{-8}$ |
| 2H8.14 | 2H8_HCvar2 | 2H8_LCvar3 | — | — | 1.52 × 10$^4$ | 2.91 × 10$^{-4}$ | 1.92 × 10$^{-8}$ |
| 2H8.15 | 2H8_HCvar3 | 2H8_LCvar3 | — | — | 1.22 × 10$^4$ | 2.78 × 10$^{-4}$ | 2.28 × 10$^{-8}$ |
| 2H8.16 | 2H8_HCvar4 | 2H8_LCvar3 | — | — | 1.67 × 10$^4$ | 6.31 × 10$^{-4}$ | 3.78 × 10$^{-8}$ |
| 2H8.17 | 2H8_HCvar5 | 2H8_LCvar3 | — | — | 1.36 × 10$^4$ | 2.59 × 10$^{-4}$ | 1.90 × 10$^{-8}$ |
| 2H8.18 | 2H8_HCvar6 | 2H8_LCvar3 | — | — | 1.20 × 10$^4$ | 3.90 × 10$^{-4}$ | 3.24 × 10$^{-8}$ |
| 2H8.19 | 2H8_HC | 2H8_LCvar4 | — | — | 1.59 × 10$^4$ | 6.74 × 10$^{-4}$ | 4.25 × 10$^{-8}$ |
| 2H8.20 | 2H8_HCvar2 | 2H8_LCvar4 | — | — | 1.58 × 10$^4$ | 1.47 × 10$^{-3}$ | 9.34 × 10$^{-8}$ |
| 2H8.21 | 2H8_HCvar3 | 2H8_LCvar4 | — | — | 1.14 × 10$^4$ | 1.04 × 10$^{-3}$ | 9.05 × 10$^{-8}$ |
| 2H8.22 | 2H8_HCvar4 | 2H8_LCvar4 | — | — | 3.59 × 10$^4$ | 1.09 × 10$^{-2}$ | 3.04 × 10$^{-7}$ |
| 2H8.23 | 2H8_HCvar5 | 2H8_LCvar4 | — | — | 1.27 × 10$^4$ | 1.01 × 10$^{-3}$ | 7.94 × 10$^{-8}$ |
| 2H8.24 | 2H8_HCvar6 | 2H8_LCvar4 | — | — | 1.33 × 10$^4$ | 2.43 × 10$^{-3}$ | 1.83 × 10$^{-7}$ |
| 2H8.25 | 2H8_HC | 2H8_LCvar5 | — | — | 1.65 × 10$^4$ | 2.51 × 10$^{-4}$ | 1.52 × 10$^{-8}$ |
| 2H8.26 | 2H8_HCvar2 | 2H8_LCvar5 | — | — | 1.70 × 10$^4$ | 3.12 × 10$^{-4}$ | 1.83 × 10$^{-8}$ |
| 2H8.27 | 2H8_HCvar3 | 2H8_LCvar5 | — | — | 1.41 × 10$^4$ | 2.40 × 10$^{-4}$ | 1.70 × 10$^{-8}$ |
| 2H8.28 | 2H8_HCvar4 | 2H8_LCvar5 | — | — | 1.82 × 10$^4$ | 6.20 × 10$^{-4}$ | 3.40 × 10$^{-8}$ |
| 2H8.29 | 2H8_HCvar5 | 2H8_LCvar5 | — | — | 1.37 × 10$^4$ | 2.55 × 10$^{-4}$ | 1.86 × 10$^{-8}$ |
| 2H8.30 | 2H8_HCvar6 | 2H8_LCvar5 | — | — | 1.29 × 10$^4$ | 2.74 × 10$^{-4}$ | 2.12 × 10$^{-8}$ |
| 2H8.31 | 2H8_HC | 2H8_LCvar6 | 94% | 33 | 1.52 × 10$^4$ | 1.68 × 10$^{-4}$ | 1.11 × 10$^{-8}$ |
| 2H8.32 | 2H8_HCvar2 | 2H8_LCvar6 | 86% | 61 | 1.51 × 10$^4$ | 1.72 × 10$^{-4}$ | 1.14 × 10$^{-8}$ |
| 2H8.33 | 2H8_HCvar3 | 2H8_LCvar6 | — | — | 1.45 × 10$^4$ | 1.71 × 10$^{-4}$ | 1.18 × 10$^{-8}$ |
| 2H8.34 | 2H8_HCvar4 | 2H8_LCvar6 | — | — | 1.67 × 10$^4$ | 4.25 × 10$^{-4}$ | 2.55 × 10$^{-8}$ |
| 2H8.35 | 2H8_HCvar5 | 2H8_LCvar6 | 85% | 41 | 1.12 × 10$^4$ | 1.71 × 10$^{-4}$ | 1.52 × 10$^{-8}$ |
| 2H8.36 | 2H8_HCvar6 | 2H8_LCvar6 | — | — | 1.16 × 10$^4$ | 2.73 × 10$^{-4}$ | 2.35 × 10$^{-8}$ |
| 2H8.37 | 2H8_HC | 2H8_LCvar7 | 93% | 32 | 2.02 × 10$^4$ | 3.31 × 10$^{-4}$ | 1.64 × 10$^{-8}$ |
| 2H8.38 | 2H8_HCvar2 | 2H8_LCvar7 | — | — | 1.85 × 10$^4$ | 3.29 × 10$^{-4}$ | 1.78 × 10$^{-8}$ |
| 2H8.39 | 2H8_HCvar3 | 2H8_LCvar7 | 86% | 43 | 1.66 × 10$^4$ | 2.17 × 10$^{-4}$ | 1.30 × 10$^{-8}$ |
| 2H8.40 | 2H8_HCvar4 | 2H8_LCvar7 | — | — | 2.39 × 10$^4$ | 4.56 × 10$^{-4}$ | 1.91 × 10$^{-8}$ |
| 2H8.41 | 2H8_HCvar5 | 2H8_LCvar7 | 86% | 36 | 1.85 × 10$^4$ | 1.97 × 10$^{-4}$ | 1.07 × 10$^{-8}$ |
| 2H8.42 | 2H8_HCvar6 | 2H8_LCvar7 | 97% | 53 | 1.90 × 10$^4$ | 2.21 × 10$^{-4}$ | 1.16 × 10$^{-8}$ |

Humanization of Antibody 2H8

Antibody 2H8 was humanized by replacing the mouse frameworks with human frameworks. The light chain CDRs were grafted into the human kappa1 consensus framework, and several variants where particular Vernier positions were back-mutated to mouse residues were made as well. The five light chain variants are set forth SEQ ID NOs:316-320. The heavy chain was treated similarly; the CDRs were grafted into the human VH1 consensus framework, and several variants with mouse back-mutations were prepared (SEQ ID NOs:310-315). The humanized variants were expressed and affinities, cell-based IC$_{50}$ values, and percent maximum inhibition of BACE1 were determined (Table 6).

TABLE 6

Properties of humanized 2H8 variants

| Variant | Heavy Chain | Light Chain | K$_D$ (M) | IC$_{50}$ (nM) | Max. % inhibition |
|---|---|---|---|---|---|
| 2H8.01 | 2H8_HC (SEQ ID NO: 23) | 2H8_LC (SEQ ID NO: 122) | 1.48 × 10$^{-8}$ | 24.84 | 82% |
| hu2H8v1 | hu2H8_HC1 (SEQ ID NO: 310) | hu2H8_LC1 (SEQ ID NO: 316) | 1.35 × 10$^{-7}$ | — | — |
| hu2H8v2 | hu2H8_HC2 (SEQ ID NO: 311) | hu2H8_LC1 (SEQ ID NO: 316) | 1.85 × 10$^{-7}$ | — | — |
| hu2H8v3 | hu2H8_HC3 (SEQ ID NO: 312) | hu2H8_LC1 (SEQ ID NO: 316) | 1.72 × 10$^{-7}$ | — | — |
| hu2H8v4 | hu2H8_HC5 (SEQ ID NO: 313) | hu2H8_LC1 (SEQ ID NO: 316) | 1.69 × 10$^{-7}$ | — | — |
| hu2H8v5 | hu2H8_HC6 (SEQ ID NO: 314) | hu2H8_LC1 (SEQ ID NO: 316) | 9.63 × 10$^{-8}$ | — | — |
| hu2H8v6 | hu2H8_HC7 (SEQ ID NO: 315) | hu2H8_LC1 (SEQ ID NO: 316) | 1.09 × 10$^{-7}$ | — | — |
| hu2H8v7 | hu2H8_HC1 (SEQ ID NO: 310) | hu2H8_LC2 (SEQ ID NO: 317) | 1.50 × 10$^{-7}$ | — | — |

TABLE 6-continued

Properties of humanized 2H8 variants

| Variant | Heavy Chain | Light Chain | $K_D$ (M) | $IC_{50}$ (nM) | Max. % inhibition |
|---|---|---|---|---|---|
| hu2H8v8 | hu2H8_HC2 (SEQ ID NO: 311) | hu2H8_LC2 (SEQ ID NO: 317) | $1.55 \times 10^{-7}$ | — | — |
| hu2H8v9 | hu2H8_HC3 (SEQ ID NO: 312) | hu2H8_LC2 (SEQ ID NO: 317) | $1.30 \times 10^{-7}$ | — | — |
| hu2H8v10 | hu2H_HC5 (SEQ ID NO: 313) | hu2H8_LC2 (SEQ ID NO: 317) | $1.60 \times 10^{-7}$ | — | — |
| hu2H8v11 | hu2H8_HC6 (SEQ ID NO: 314) | hu2H8_LC2 (SEQ ID NO: 317) | $8.83 \times 10^{-8}$ | — | — |
| hu2H8v12 | hu2H8_HC7 (SEQ ID NO: 315) | hu2H8_LC2 (SEQ ID NO: 317) | $1.71 \times 10^{-7}$ | — | — |
| hu2H8v13 | hu2H8_HC1 (SEQ ID NO: 310) | hu2H8_LC3 (SEQ ID NO: 318) | $2.28 \times 10^{-8}$ | — | — |
| hu2H8v14 | hu2H8_HC2 (SEQ ID NO: 311) | hu2H8_LC3 (SEQ ID NO: 318) | $1.77 \times 10^{-8}$ | — | — |
| hu2H8v15 | hu2H8_HC3 (SEQ ID NO: 312) | hu2H8_LC3 (SEQ ID NO: 318) | $1.64 \times 10^{-8}$ | — | — |
| hu2H8v16 | hu2H8_HC5 (SEQ ID NO: 313) | hu2H8_LC3 (SEQ ID NO: 318) | $2.56 \times 10^{-8}$ | — | — |
| hu2H8v17 | hu2H8_HC6 (SEQ ID NO: 314) | hu2H8_LC3 (SEQ ID NO: 318) | $1.21 \times 10^{-8}$ | 22.08 | 91% |
| hu2H8v18 | hu2H8_HC7 (SEQ ID NO: 315) | hu2H8_LC3 (SEQ ID NO: 318) | $2.07 \times 10^{-8}$ | — | — |
| hu2H8v19 | hu2H8_HC1 (SEQ ID NO: 310) | hu2H8_LC4 (SEQ ID NO: 319) | $1.74 \times 10^{-8}$ | — | — |
| hu2H8v20 | hu2H8_HC2 (SEQ ID NO: 311) | hu2H8_LC4 (SEQ ID NO: 319) | $1.32 \times 10^{-8}$ | — | — |
| hu2H8v21 | hu2H8_HC3 (SEQ ID NO: 312) | hu2H8_LC4 (SEQ ID NO: 319) | $1.35 \times 10^{-8}$ | No Inhibition | — |
| hu2H8v22 | hu2H8_HC5 (SEQ ID NO: 313) | hu2H8_LC4 (SEQ ID NO: 319) | $2.19 \times 10^{-8}$ | — | — |
| hu2H8v23 | hu2H8_HC6 (SEQ ID NO: 314) | hu2H8_LC4 (SEQ ID NO: 319) | $2.80 \times 10^{-8}$ | — | — |
| hu2H8v24 | hu2H8_HC7 (SEQ ID NO: 315) | hu2H8_LC4 (SEQ ID NO: 319) | $7.40 \times 10^{-8}$ | — | — |
| hu2H8v25 | hu2H8_HC1 (SEQ ID NO: 310) | hu2H8_LC5 (SEQ ID NO: 320) | $2.21 \times 10^{-8}$ | — | — |
| hu2H8v26 | hu2H8_HC2 (SEQ ID NO: 311) | hu2H8_LC5 (SEQ ID NO: 320) | $1.63 \times 10^{-8}$ | — | — |
| hu2H8v27 | hu2H8_HC3 (SEQ ID NO: 312) | hu2H8_LC5 (SEQ ID NO: 320) | $1.28 \times 10^{-8}$ | 16.5 | 85% |
| hu2H8v28 | hu2H8_HC5 (SEQ ID NO: 313) | hu2H8_LC5 (SEQ ID NO: 320) | $1.95 \times 10^{-8}$ | — | — |
| hu2H8v29 | hu2H8_HC6 (SEQ ID NO: 314) | hu2H8_LC5 (SEQ ID NO: 320) | $1.20 \times 10^{-8}$ | 14.76 | 86% |
| hu2H8v30 | hu2H8_HC7 (SEQ ID NO: 315) | hu2H8_LC5 (SEQ ID NO: 320) | $2.37 \times 10^{-8}$ | — | — |

Affinity Maturation of Humanized 2H8 Antibodies

Humanized 2H8 variants hu2H8_HC6 (SEQ ID NO:314) and hu2H8_LC5 (SEQ ID NO:320) were selected for the generation of a number of affinity matured VH and VL sequences, respectively. The amino acid sequences of the affinity matured VH sequences are set forth under SEQ ID NOS:448-462 in Table 12. The amino acid sequences of the affinity matured VL sequences are set forth under SEQ ID NOS:437-447 in Table 12.

The binding affinities of the affinity matured humanized 2H8 variants for BACE1 were determined by surface plasmon resonance using a Biacore™ 8K instrument. Briefly, affinity matured humanized 2H8 variants were captured using a Human Fc Capture Kit (GE Healthcare Life Sciences, BR100839) on a Biacore™ Series S CM5 sensor chip (GE Healthcare Life Sciences, 29149604) at 25° C. Serial 3-fold dilutions of recombinant BACE1 (R&D systems, 931-AS), i.e., to concentrations of 300 nM, 100 nM, 33.3 nM, 11.1 nM, and 0 nM, were made and injected at a flow rate of 30 µL/min. The binding was monitored for 300 seconds and then dissociation was monitored for 600+ seconds in HBS-EP+ running buffer (GE Healthcare Life Sciences, BR100669). Binding response was corrected by subtracting the RU from a blank flow cell. A 1:1 Langmuir model of simultaneous fitting of $k_{on}$ and $k_{off}$ was used for kinetics analysis. $K_D$ values are presented in Tables 10 and 11 below.

TABLE 10

Affinity Matured Humanized 2H8 Variant Affinities

| Clone | VH/VL Sequences | $K_D$ (M) |
|---|---|---|
| hu2H8v29 | hu2H8_HC6 (SEQ ID NO: 314) + hu2H8_LC5 (SEQ ID NO: 320) | 9.21E−09 |
| hu2H8v29.1 | hu2H8_HC6 (SEQ ID NO: 314) + hu2H8_LC5.1 (SEQ ID NO: 437) | 7.22E−09 |

TABLE 10-continued

Affinity Matured Humanized 2H8 Variant Affinities

| Clone | VH/VL Sequences | $K_D$ (M) |
|---|---|---|
| hu2H8v29.2 | hu2H8_HC6 (SEQ ID NO: 314) + hu2H8_LC5.2 (SEQ ID NO: 438) | 8.16E−09 |
| hu2H8v29.3 | hu2H8_HC6 (SEQ ID NO: 314) + hu2H8_LC5.3 (SEQ ID NO: 439) | 6.93E−09 |
| hu2H8v29.4 | hu2H8_HC6 (SEQ ID NO: 314) + hu2H8_LC5.4 (SEQ ID NO: 440) | 6.53E−09 |
| hu2H8v29.5 | hu2H8_HC6 (SEQ ID NO: 314) + hu2H8_LC5.5 (SEQ ID NO: 441) | 8.21E−09 |
| hu2H8v29.6 | hu2H8_HC6 (SEQ ID NO: 314) + hu2H8_LC5.6 (SEQ ID NO: 442) | 7.51E−09 |
| hu2H8v29.7 | hu2H8_HC6 (SEQ ID NO: 314) + hu2H8_LC5.7 (SEQ ID NO: 443) | 4.99E−09 |
| hu2H8v29.8 | hu2H8_HC6 (SEQ ID NO: 314) + hu2H8_LC5.8 (SEQ ID NO: 444) | 8.10E−09 |
| hu2H8v29.9 | hu2H8_HC6 (SEQ ID NO: 314) + hu2H8_LC5.9 (SEQ ID NO: 445) | 1.10E−08 |
| hu2H8v29.10 | hu2H8_HC6 (SEQ ID NO: 314) + hu2H8_LC5.10 (SEQ ID NO: 446) | 4.84E−09 |
| hu2H8v29.11 | hu2H8_HC6 (SEQ ID NO: 314) + hu2H8_LC5.11 (SEQ ID NO: 447) | 4.83E−09 |

TABLE 11

Affinity Matured Humanized 2H8 Variant Affinities

| Clone | VL/VH Sequences | $K_D$ (M) |
|---|---|---|
| hu2H8v29 | hu2H8_LC5 (SEQ ID NO: 320) + hu2H8_HC6 (SEQ ID NO: 314) | 9.21E−09 |
| hu2H8v29.12 | hu2H8_LC5 (SEQ ID NO: 320) + hu2H8_HC6.1 (SEQ ID NO: 448) | 8.42E−09 |
| hu2H8v29.13 | hu2H8_LC5 (SEQ ID NO: 320) + hu2H8_HC6.2 (SEQ ID NO: 449) | 9.16E−09 |
| hu2H8v29.14 | hu2H8_LC5 (SEQ ID NO: 320) + hu2H8_HC6.3 (SEQ ID NO: 450) | 9.32E−09 |
| hu2H8v29.15 | hu2H8_LC5 (SEQ ID NO: 320) + hu2H8_HC6.4 (SEQ ID NO: 451) | 1.92E−08 |
| hu2H8v29.16 | hu2H8_LC5 (SEQ ID NO: 320) + hu2H8_HC6.5 (SEQ ID NO: 452) | 3.13E−08 |
| hu2H8v29.17 | hu2H8_LC5 (SEQ ID NO: 320) + hu2H8_HC6.6 (SEQ ID NO: 453) | 8.04E−09 |
| hu2H8v29.18 | hu2H8_LC5 (SEQ ID NO: 320) + hu2H8_HC6.7 (SEQ ID NO: 454) | 1.03E−08 |
| hu2H8v29.19 | hu2H8_LC5 (SEQ ID NO: 320) + hu2H8_HC6.8 (SEQ ID NO: 455) | 9.95E−09 |
| hu2H8v29.20 | hu2H8_LC5 (SEQ ID NO: 320) + hu2H8_HC6.9 (SEQ ID NO: 456) | 8.69E−09 |
| hu2H8v29.21 | hu2H8_LC5 (SEQ ID NO: 320) + hu2H8_HC6.10 (SEQ ID NO: 457) | 6.68E−09 |
| hu2H8v29.22 | hu2H8_LC5 (SEQ ID NO: 320) + hu2H8_HC6.11 (SEQ ID NO: 458) | 6.00E−09 |
| hu2H8v29.23 | hu2H8_LC5 (SEQ ID NO: 320) + hu2H8_HC6.12 (SEQ ID NO: 459) | 7.00E−09 |
| hu2H8v29.24 | hu2H8_LC5 (SEQ ID NO: 320) + hu2H8_HC6.13 (SEQ ID NO: 460) | 5.73E−09 |
| hu2H8v29.25 | hu2H8_LC5 (SEQ ID NO: 320) + hu2H8_HC6.14 (SEQ ID NO: 461) | 6.08E−09 |
| hu2H8v29.26 | hu2H8_LC5 (SEQ ID NO: 320) + hu2H8_HC6.15 (SEQ ID NO: 462) | 8.52E−09 |
| hu2H8v29.27 | hu2H8_LC5.12 (SEQ ID NO: 463) + hu2H8_HC6.16 (SEQ ID NO: 464) | 3.4E−09 |
| hu2H8v29.28 | hu2H8_LC5.12 (SEQ ID NO: 463) + hu2H8_HC6.17 (SEQ ID NO: 465) | 4.8E−09 |

Example 2. Modified Fc Polypeptides that Bind to TfR

This example describes modifications to Fc polypeptides to confer transferrin receptor (TfR) binding and transport across the blood-brain barrier (BBB).

Unless otherwise indicated, the positions of amino acid residues in this section are numbered based on EU index numbering for a human IgG1 wild-type Fc region.

Generation and Characterization of Fc Polypeptides Comprising Modifications at Positions 384, 386, 387, 388, 389, 390, 413, 416, and 421 (CH3C Clones)

Yeast libraries containing Fc regions having modifications introduced into positions including amino acid positions 384, 386, 387, 388, 389, 390, 413, 416, and 421 were generated as described below. Illustrative clones that bind to TfR are shown in Tables 7 and 8.

After an additional two rounds of sorting, single clones were sequenced and four unique sequences were identified. These sequences had a conserved Trp at position 388, and all had an aromatic residue (i.e., Trp, Tyr, or His) at position 421. There was a great deal of diversity at other positions.

The four clones selected from the library were expressed as Fc fusions to Fab fragments in CHO or 293 cells, purified by Protein A and size-exclusion chromatography, and then screened for binding to human TfR in the presence or absence of holo-Tf by ELISA. The clones all bound to human TfR and the binding was not affected by the addition of excess (5 μM) holo-Tf. Clones were also tested for binding to 293F cells, which endogenously express human TfR. The clones bound to 293F cells, although the overall binding was substantially weaker than the high-affinity positive control.

Next, it was tested whether clones could internalize in TfR-expressing cells using clone CH3C.3 as a test clone. Adherent HEK 293 cells were grown in 96-well plates to about 80% confluence, media was removed, and samples were added at 1 μM concentrations: clone CH3C.3, anti-TfR benchmark positive control antibody (Ab204), anti-BACE1 benchmark negative control antibody (Ab107), and human IgG isotype control (obtained from Jackson Immunoresearch). The cells were incubated at 37° C. and 8% $CO_2$ concentration for 30 minutes, then washed, permeabilized with 0.1% Triton™ X-100, and stained with anti-human-IgG-Alexa Fluor® 488 secondary antibody. After additional washing, the cells were imaged under a high-content fluorescence microscope (i.e., an Opera Phenix™ system), and the number of puncta per cell was quantified. At 1 μM, clone CH3C.3 showed a similar propensity for internalization to the positive anti-TfR control, while the negative controls showed no internalization.

Further Engineering of Clones Additional libraries were generated to improve the affinity of the initial hits against human TfR using a soft randomization approach, wherein DNA oligos were generated to introduce soft mutagenesis based on each of the original four hits. Additional clones were identified that bound TfR and were selected. The selected clones fell into two general sequence groups. Group 1 clones (i.e., clones CH3C.18, CH3C.21, CH3C.25, and CH3C.34) had a semi-conserved Leu at position 384, a Leu or His at position 386, a conserved and a semi-conserved Val at positions 387 and 389, respectively, and a semi-conserved P-T-W motif at positions 413, 416, and 421, respectively. Group 2 clones had a conserved Tyr at position 384, the motif TXWSX at positions 386-390, and the conserved motif S/T-E-F at positions 413, 416, and 421, respectively. Clones CH3C.18 and CH3C.35 were used in additional studies as representative members of each sequence group.

Epitope Mapping

To determine whether the engineered Fc regions bound to the apical domain of TfR, TfR apical domain was expressed on the surface of phage. To properly fold and display the apical domain, one of the loops had to be truncated and the sequence needed to be circularly permuted. Clones CH3C.18 and CH3C.35 were coated on ELISA plates and a phage ELISA protocol was followed. Briefly, after washing and blocking with 1% PB SA, dilutions of phage displaying were added and incubated at room temperature for 1 hour. The plates were subsequently washed and anti-M13-HRP was added, and after additional washing the plates were developed with TMB substrate and quenched with 2N $H_2SO_4$. Both clones CH3C.18 and CH3C.35 bound to the apical domain in this assay.

Paratope Mapping

To understand which residues in the Fc domain were most important for TfR binding, a series of mutant clone CH3C.18 and clone CH3C.35 Fc regions was created in which each mutant had a single position in the TfR binding register mutated back to wild-type. The resulting variants were expressed recombinantly as Fab-Fc fusions and tested for binding to human or cynomolgus (cyno) TfR. For clone CH3C.35, positions 388 and 421 were important for binding; reversion of either of these to wild-type completely ablated binding to human TfR.

Binding Characterization of Maturation Clones

Binding ELISAs were conducted with purified Fab-Fc fusion variants with human or cyno TfR coated on the plate, as described above. The variants from the clone CH3C.18 maturation library, clone CH3C.3.2-1, clone CH3C.3.2-5, and clone CH3C.3.2-19, bound human and cyno TfR with approximately equivalent $EC_{50}$ values, whereas the parent clones CH3C.18 and CH3C.35 had greater than 10-fold better binding to human versus cyno TfR.

Next, it was tested whether the modified Fc polypeptides internalized in human and monkey cells. Using the protocol described above, internalization in human HEK 293 cells and rhesus LLC-MK2 cells was tested. The variants that similarly bound human and cyno TfR, clones CH3C.3.2-5 and CH3C.3.2-19, had significantly improved internalization in LLC-MK2 cells as compared with clone CH3C.35.

Additional Engineering of Clones

Additional engineering to further affinity mature clones CH3C.18 and CH3C.35 involved adding additional mutations to the positions that enhanced binding through direct interactions, second-shell interactions, or structure stabilization. This was achieved via generation and selection from an "NNK walk" or "NNK patch" library. The NNK walk library involved making one-by-one NNK mutations of residues that are near to the paratope. By looking at the structure of Fc bound to FcγRI (PDB ID: 4W4O), 44 residues near the original modification positions were identified as candidates for interrogation. Specifically, the following residues were targeted for NNK mutagenesis: K248, R255, Q342, R344, E345, Q347, T359, K360, N361, Q362, 5364, K370, E380, E382, 5383, G385, Y391, K392, T393, D399, 5400, D401, 5403, K409, L410, T411, V412, K414, 5415, Q418, Q419, G420, V422, F423, 5424, 5426, Q438, 5440, 5442, L443, 5444, P4458, G446, and K447. The 44 single point NNK libraries were generated using Kunkel mutagenesis, and the products were pooled and introduced to yeast via electroporation, as described above for other yeast libraries.

The combination of these mini-libraries (each of which had one position mutated, resulting in 20 variants) generated a small library that was selected using yeast surface display for any positions that lead to higher affinity binding. Selections were performed as described above, using TfR apical domain proteins. After three rounds of sorting, clones from the enriched yeast library were sequenced, and several "hot-spot" positions were identified where certain point mutations significantly improved the binding to apical domain proteins. For clone CH3C.35, these mutations included E380 (mutated to Trp, Tyr, Leu, or Gln) and 5415 (mutated to Glu). The sequences of the clone CH3C.35 single and combination mutants are set forth in SEQ ID NOs:183-187 and 243-249. For clone CH3C.18, these mutations included E380 (mutated to Trp, Tyr, or Leu) and K392 (mutated to Gln, Phe, or His). The sequences of the clone CH3C.18 single mutants are set forth in SEQ ID NOs:237-242.

Additional Maturation Libraries to Improve Clone CH3C.35 Affinity

An additional library to identify combinations of mutations from the NNK walk library, while adding several additional positions on the periphery of these, was generated as described for previous yeast libraries. In this library, the YxTEWSS (SEQ ID NO:308) and TxxExxxxF (SEQ ID NO:309) motifs were kept constant, and six positions were completely randomized: E380, K392, K414, S415, S424, and S426. Positions E380 and S415 were included because they were "hot spots" in the NNK walk library. Positions K392, S424, and S426 were included because they make up part of the core that may position the binding region, while K414 was selected due to its adjacency to position 415.

This library was sorted, as previously described, with the cyno TfR apical domain only. The enriched pool was sequenced after five rounds, and the sequences of the modified regions of the identified unique clones are set forth in SEQ ID NOs:188 and 252-268.

The next libraries were designed to further explore acceptable diversity in the main binding paratope. Each of the original positions (384, 386, 387, 388, 389, 390, 413, 416, and 421) plus the two hot spots (380 and 415) were individually randomized with NNK codons to generate a series of single-position saturation mutagenesis libraries on yeast. In addition, each position was individually reverted to the wild-type residue, and these individual clones were displayed on yeast. It was noted that positions 380, 389, 390, and 415 were the only positions that retained substantial binding to TfR upon reversion to the wild-type residue (some residual but greatly diminished binding was observed for reversion of 413 to wild-type).

The single-position NNK libraries were sorted for three rounds against the human TfR apical domain to collect the top ~5% of binders, and then at least 16 clones were sequenced from each library. The results indicate what amino acids at each position can be tolerated without significantly reducing binding to human TfR, in the context of clone CH3C.35. A summary is below:
Position 380: Trp, Leu, or Glu;
Position 384: Tyr or Phe;
Position 386: Thr only;
Position 387: Glu only;
Position 388: Trp only;
Position 389: Ser, Ala, or Val (although the wild type Asn residue seems to retain some binding, it did not appear following library sorting);
Position 390: Ser or Asn;
Position 413: Thr or Ser;
Position 415: Glu or Ser;
Position 416: Glu only; and
Position 421: Phe only.

The above residues, when substituted into clone CH3C.35 as single changes or in combinations, represent paratope diversity that retains binding to TfR apical domain. Clones having mutations at these positions include those shown in Table 8, and the sequences of the CH3 domains of these clones are set forth in SEQ ID NOs:183-219.

Example 3. Additional Fc Positions that can be Modified to Confer TfR Binding Additional modified Fc polypeptides that bind to transferrin receptor (TfR) were generated having modifications at alternative sites in the Fc region, e.g., at the following positions:

positions 274, 276, 283, 285, 286, 287, 288, and 290 (CH2A2 clones);
positions 266, 267, 268, 269, 270, 271, 295, 297, 298, and 299 (CH2C clones);
positions 268, 269, 270, 271, 272, 292, 293, 294, and 300 (CH2D clones);
positions 272, 274, 276, 322, 324, 326, 329, 330, and 331 (CH2E3 clones); or
positions 345, 346, 347, 349, 437, 438, 439, and 440 (CH3B clones).

Illustrative CH3B clones that bind to TfR are set forth in SEQ ID NOs:277-281. Illustrative CH2A2 clones that bind to TfR are set forth in SEQ ID NOs:282-286. Illustrative CH2C clones that bind to TfR are set forth in SEQ ID NOs:287-291. Illustrative CH2D clones that bind to TfR are set forth in SEQ ID NOs:292-296. Illustrative CH2E3 clones that bind to TfR are set forth in SEQ ID NOs:297-301.

Example 4. Methods

Generation of Phage-Display Libraries

A DNA template coding for the wild-type human Fc sequence was synthesized and incorporated into a phagemid vector. The phagemid vector contained an ompA or pelB leader sequence, the Fc insert fused to c-Myc and 6×His (SEQ ID NO:611) epitope tags, and an amber stop codon followed by M13 coat protein pIII.

Primers containing "NNK" tricodons at the desired positions for modifications were generated, where N is any DNA base (i.e., A, C, G, or T) and K is either G or T. Alternatively, primers for "soft" randomization were used, where a mix of bases corresponding to 70% wild-type base and 10% of each of the other three bases was used for each randomization position. Libraries were generated by performing PCR amplification of fragments of the Fc region corresponding to regions of randomization and then assembled using end primers containing SfiI restriction sites, then digested with SfiI and ligated into the phagemid vectors. Alternatively, the primers were used to conduct Kunkel mutagenesis. The ligated products or Kunkel products were transformed into electrocompetent *E. coli* cells of strain TG1 (obtained from Lucigen®). The *E. coli* cells were infected with M13K07 helper phage after recovery and grown overnight, after which library phage were precipitated with 5% PEG/NaCl, resuspended in 15% glycerol in PBS, and frozen until use. Typical library sizes ranged from about $10^9$ to about $10^{11}$ transformants. Fc-dimers were displayed on phage via pairing between pIII-fused Fc and soluble Fc not attached to pIII (the latter being generated due to the amber stop codon before pIII).

Generation of Yeast-Display Libraries

A DNA template coding for the wild-type human Fc sequence was synthesized and incorporated into a yeast display vector. For CH2 and CH3 libraries, the Fc polypeptides were displayed on the Aga2p cell wall protein. Both vectors contained prepro leader peptides with a Kex2 cleavage sequence, and a c-Myc epitope tag fused to the terminus of the Fc.

Yeast display libraries were assembled using methods similar to those described for the phage libraries, except that amplification of fragments was performed with primers containing homologous ends for the vector. Freshly prepared electrocompetent yeast (i.e., strain EBY100) were electroporated with linearized vector and assembled library inserts. Electroporation methods will be known to one of skill in the art. After recovery in selective SD-CAA media, the yeast were grown to confluence and split twice, then induced for protein expression by transferring to SG-CAA media. Typical library sizes ranged from about $10^7$ to about $10^9$ transformants. Fc-dimers were formed by pairing of adjacently displayed Fc monomers.

General Methods for Phage Selection

Phage methods were adapted from Phage Display: A Laboratory Manual (Barbas, 2001). Additional protocol details can be obtained from this reference.

Plate Sorting Methods

Antigen was coated on MaxiSorpx microtiter plates (typically 1-10 μg/mL) overnight at 4° C. The phage libraries were added into each well and incubated overnight for binding. Microtiter wells were washed extensively with PBS containing 0.05% Tween® 20 (PBST) and bound phage were eluted by incubating the wells with acid (typically 50 mM HCl with 500 mM KCl, or 100 mM glycine, pH 2.7) for 30 minutes. Eluted phage were neutralized with 1 M Tris (pH 8) and amplified using TG1 cells and M13/KO7 helper phage and grown overnight at 37° C. in 2YT media containing 50 μg/mL carbenacillin and 50 ug/mL kanamycin. The titers of phage eluted from a target-containing well were compared to titers of phage recovered from a non-target-containing well to assess enrichment. Selection stringency was increased by subsequently decreasing the incubation time during binding and increasing washing time and number of washes.

Bead Sorting Methods

Antigen was biotinylated through free amines using NHS-PEG4-Biotin (obtained from Pierce™). For biotinylation reactions, a 3- to 5-fold molar excess of biotin reagent was used in PBS. Reactions were quenched with Tris followed by extensive dialysis in PBS. The biotinylated antigen was immobilized on streptavidin-coated magnetic beads, (i.e., M280-streptavidin beads obtained from Thermo Fisher). The phage display libraries were incubated with the antigen-coated beads at room temperature for 1 hour. The unbound phage were then removed and beads were washed with PBST. The bound phage were eluted by incubating with 50 mM HCl containing 500 mM KCl (or 0.1 M glycine, pH 2.7) for 30 minutes, and then neutralized and propagated as described above for plate sorting.

After three to five rounds of panning, single clones were screened by either expressing Fc on phage or solubly in the E. coli periplasm. Such expression methods will be known to one of skill in the art. Individual phage supernatants or periplasmic extracts were exposed to blocked ELISA plates coated with antigen or a negative control and were subsequently detected using HRP-conjugated goat anti-Fc (obtained from Jackson Immunoresearch) for periplasmic extracts or anti-M13 (GE Healthcare) for phage, and then developed with TMB reagent (obtained from Thermo Fisher). Wells with $OD_{450}$ values greater than around 5-fold over background were considered positive clones and sequenced, after which some clones were expressed either as a soluble Fc fragment or fused to Fab fragments General Methods for Yeast Selection Bead Sorting (Magnetic-Assisted Cell Sorting (MACS)) Methods MACS and FACS selections were performed similarly to as described in Ackerman, et al. 2009 *Biotechnol. Prog.* 25(3), 774. Streptavidin magnetic beads (e.g., M-280 streptavidin beads from ThermoFisher) were labeled with biotinylated antigen and incubated with yeast (typically 5-10× library diversity). Unbound yeast were removed, the beads were washed, and bound yeast were grown in selective media and induced for subsequent rounds of selection.

Fluorescence-Activated Cell Sorting (FACS) Methods

Yeast were labeled with anti-c-Myc antibody to monitor expression and biotinylated antigen (concentration varied depending on the sorting round). In some experiments, the antigen was pre-mixed with streptavidin-Alexa Fluor® 647 in order to enhance the avidity of the interaction. In other experiments, the biotinylated antigen was detected after binding and washing with streptavidin-Alexa Fluor® 647. Singlet yeast with binding were sorted using a FACS Aria III cell sorter. The sorted yeast were grown in selective media then induced for subsequent selection rounds.

After an enriched yeast population was achieved, yeast were plated on SD-CAA agar plates and single colonies were grown and induced for expression, then labeled as described above to determine their propensity to bind to the target. Positive single clones were subsequently sequenced for binding antigen, after which some clones were expressed either as a soluble Fc fragment or as fused to Fab fragments.

General Methods for Screening

Screening by ELISA

Clones were selected from panning outputs and grown in individual wells of 96-well deep-well plates. The clones were either induced for periplasmic expression using auto-induction media (obtained from EMD Millipore) or infected with helper phage for phage-display of the individual Fc variants on phage. ELISA plates were coated with antigen, typically at 0.5 mg/mL overnight, then blocked with 1% BSA before addition of phage or periplasmic extracts. After a 1-hour incubation and washing off unbound protein, HRP-conjugated secondary antibody was added (i.e., anti-Fc or anti-M13 for soluble Fc or phage-displayed Fc, respectively) and incubated for 30 minutes. The plates were washed again, and then developed with TMB reagent and quenched with 2N sulfuric acid. Absorbance at 450 nm was quantified using a plate reader (BioTek®) and binding curves were polotted using Prism software where applicable. In some assays, soluble transferrin or other competitor was added during the binding step, typically at significant molar excess.

Screening by Flow Cytometry

Fc variant polypeptides (expressed either on phage, in periplasmic extracts, or solubly as fusions to Fab fragments) were added to cells in 96-well V-bottom plates (about 100,000 cells per well in PBS+1%BSA (PBSA)), and incubated at 4° C. for 1 hour. The plates were subsequently spun and the media was removed, and then the cells were washed once with PBSA. The cells were resuspended in PBSA containing secondary antibody (typically goat anti-human-IgG-Alexa Fluor® 647 (obtained from Thermo Fisher)). After 30 minutes, the plates were spun and the media was removed, the cells were washed 1-2 times with PBSA, and then the plates were read on a flow cytometer (i.e., a FACSCanto™ II flow cytometer). Median fluorescence values were calculated for each condition using FlowJo software and binding curves were plotted with Prism software.

Example 5. In Vitro and In Vivo Characterization of Anti-BACE1 Antibody Comprising a TfR-Binding Fc Polypeptide This example describes the characterization of an anti-BACE1 2H8 antibody comprising a TfR-binding Fc polypeptide using a cell-based assay and a transgenic mouse model of tauopathy.

In Vitro Characterization of Anti-BACE1 Antibody

CHOK1-huAPP cells (15,000/well) were plated on tissue culture-treated 96-well plates (Thermo Sci Nunclon Delta Surface) in 100 μL/well DMEM/F12 media supplemented with 10% FBS. After plating, cells recovered overnight at 37° C. with 5% $CO_2$. For the treatments, antibodies were first serially diluted in media at 1000 to 0.06 nM (4-fold dilutions) and 1 respectively. The media was entirely replaced with 100 μL diluted treatment with duplicate wells for each condition. Cells were then kept at 37° C. with 5% $CO_2$ for 24 hours. Following the 24 hour treatment, the media was collected for Aβ40 measurement. Measurements of human Aβ1-40 (from the human neuron cultures) were conducted according to the Cisbio Aβ1-40 ELISA kit (Cisbio #62B4OPEG). Briefly, the kit provided two anti-Aβ1-40 antibodies that act as a FRET donor and receptor pair: one antibody was labeled with Eu3+-Cryptate (FRET donor) and the other with XL-665 (FRET receptor). Both antibodies were incubated with 5 μL of media, harvested from human neuron cultures, in a PerkinElmer OptiPlate 384 for 24 hours at 4° C. The plate was then read and Aβ1-40 concentration was calculated from a 665 nm/620 nm ratio.

Figures 5A, 5B:
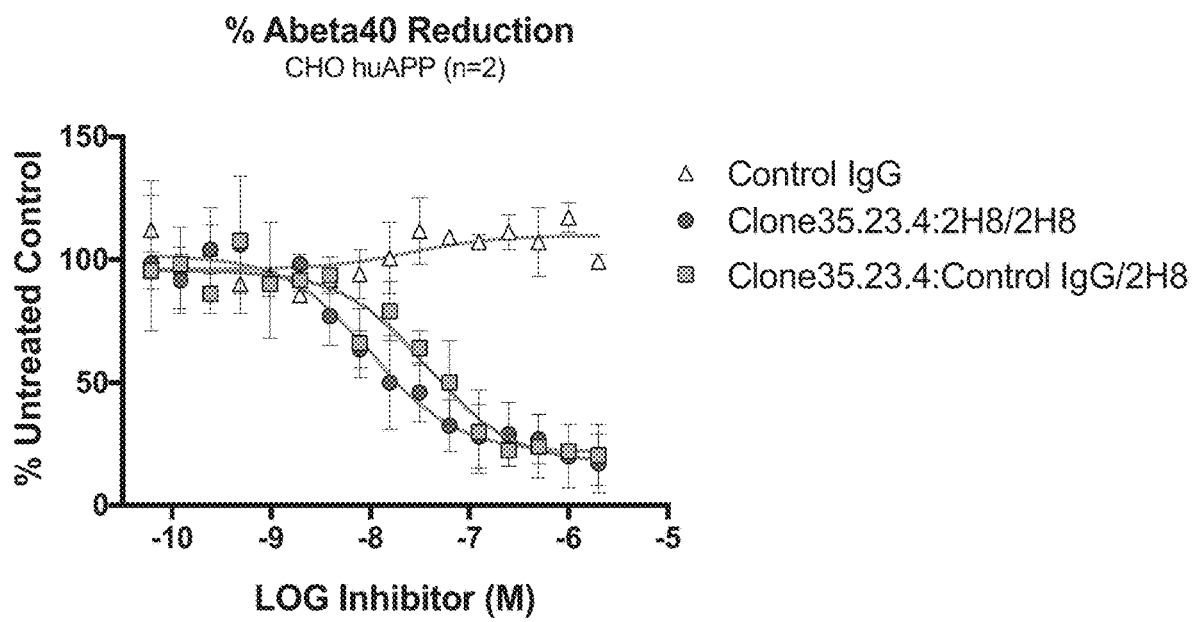
FIGS. 5A and 5B show that bivalent and monovalent anti-BACE1 2H8 reduced Aβ in a cell-based assay.

As shown in FIGS. 5A and 5B, both a bivalent anti-BACE1 2H8 antibody comprising a TfR-binding Fc polypeptide (Clone35.23.4:2H8/2H8) and a monovalent anti-BACE1 2H8 antibody comprising a TfR-binding Fc polypeptide (Clone35.23.4:Control IgG (anti-RSV antibody)/2H8) reduced Aβ in a cell-based assay. The anti-BACE1 2H8 antibody contained a light chain variable region comprising SEQ ID NO:463 and a heavy chain variable region comprising SEQ ID NO:464. FIG. 5A shows that for CHO cells stably overexpressing human APP, incubation with the bivalent 2H8 or monovalent 2H8 antibody reduced human Aβ40 in a dose-dependent manner, whereas control IgG (anti-RSV antibody) treatment had no effect. FIG. 5B shows that a bivalent 2H8 antibody had a cellular IC50 value of 10 nM and reduced Aβ by 78% compared to an untreated control, while a monovalent 2H8 antibody had a cellular IC50 value of 37 nM and reduced Aβ40 by 83% compared to an untreated control.

In Vivo Characterization of Anti-BACE1 Antibody Comprising TfR-Binding Fc Polypeptide Using PS19/TfR$^{ms/hu}$ KI Mice A transgenic mouse model of tauopathy comprising a human TfR knock-in (TfR$^{ms/hu}$ KI) was used for in vivo pharmacokinetic (PK) and pharmacodynamic (PD) evaluation. Such a model can be used, for example, to measure and/or compare maximum brain concentration ($C_{max}$) and/or brain exposure, e.g., to determine whether $C_{max}$ is increased and/or brain exposure is prolonged. PS19 is a transgenic mouse model that harbors the T34 isoform of microtubule-associated protein tau with one N-terminal insert and four microtubule binding repeats (1N4R) encoding the human P301S mutation, all driven by the mouse prion protein promoter (see, the Jackson Laboratory).

TfR$^{ms/hu}$ KI mice were generated using CRISPR/Cas9 technology to express human Tfrc apical domain within the murine Tfrc gene; the resulting chimeric TfR was expressed in vivo under the control of the endogenous promoter. As described in International Patent Application No. PCT/US2018/018302, which is incorporated by reference in its entirety herein, C57B16 were used to generate a knock-in of the human apical TfR mouse line via pronuclear microinjection into single cell embryos, followed by embryo transfer to pseudo pregnant females. Specifically, Cas9, single guide RNAs, and a donor DNA were introduced into the embryos. The donor DNA comprised a human TfR apical domain coding sequence that had been codon optimized for expression in mouse. The donor DNA comprised a human apical domain coding sequence that had been codon optimized for expression in mouse. The apical domain coding sequence was flanked with a left and a right homology arm. The donor sequence was designed such that the apical domain was inserted after the fourth mouse exon, and was immediately flanked at the 3' end by the ninth mouse exon. The resulting chimeric TfR was expressed in vivo under the control of the endogenous promoter. A founder male from the progeny of the female that received the embryos was bred to wild-type females to generate F1 heterozygous mice. Homozygous TfR$^{ms/hu}$ mice were subsequently generated from breeding of F1 generation heterozygous mice. To generate PS19/TfR$^{ms/hu}$ KI mice, PS19$^{+/-}$ male mice were first crossed with TfR$^{ms/hu}$ +/+ female mice to generate PS19$^{+/-}$; TfR$^{ms/hu}$ -/+ mice. The PS19$^{+/-}$; TfR$^{ms/hu}$ -/+ male mice were further crossed with TfR$^{ms/hu}$ KI/KI female mice to generate PS19$^{+/-}$; TfR$^{ms/hu}$ +/+ mice for the in vivo studies.

For PK/PD evaluation, PS19/TfR$^{ms/hu}$ KI mice were systemically dosed with antibody one time via tail vein at 50 mg/kg. Prior to perfusion with PBS, blood was collected in EDTA plasma tubes via cardiac puncture and spun at 14,000 rpm for 5 minutes. Plasma was then isolated for subsequent PK/PD analysis. Brains were extracted after perfusion and hemi-brains were isolated for homogenization in 10× by tissue weight of 1% NP-40 in PBS (for PK) or 5 M GuHCl (for PD).

Figure 6A:
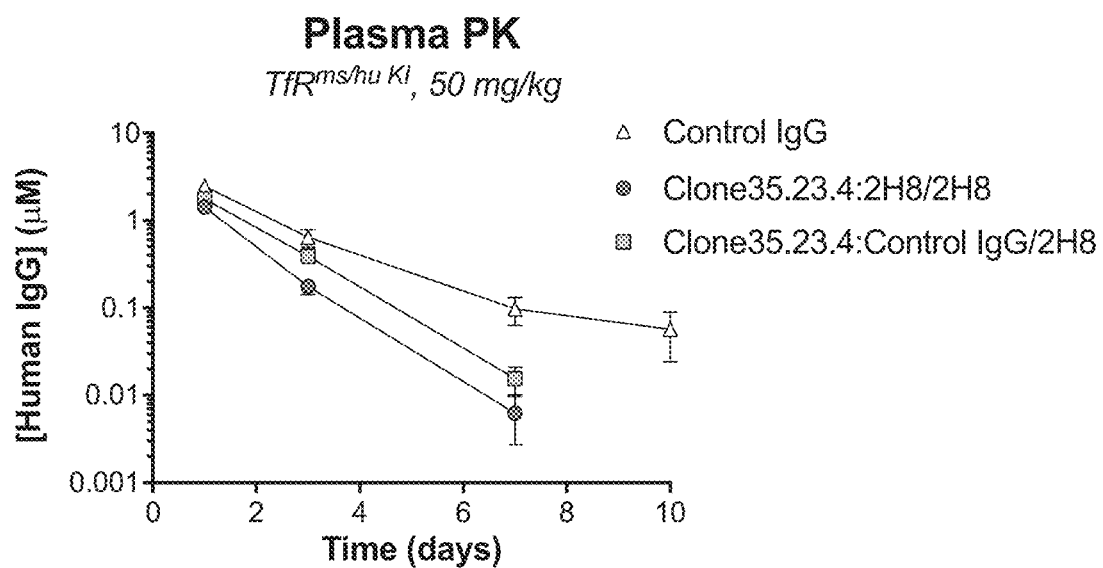
FIGS. 6A-6D show brain and plasma PK/PD in PS19/TfR$^{ms/hu}$ KI mice.
Figure 6B:
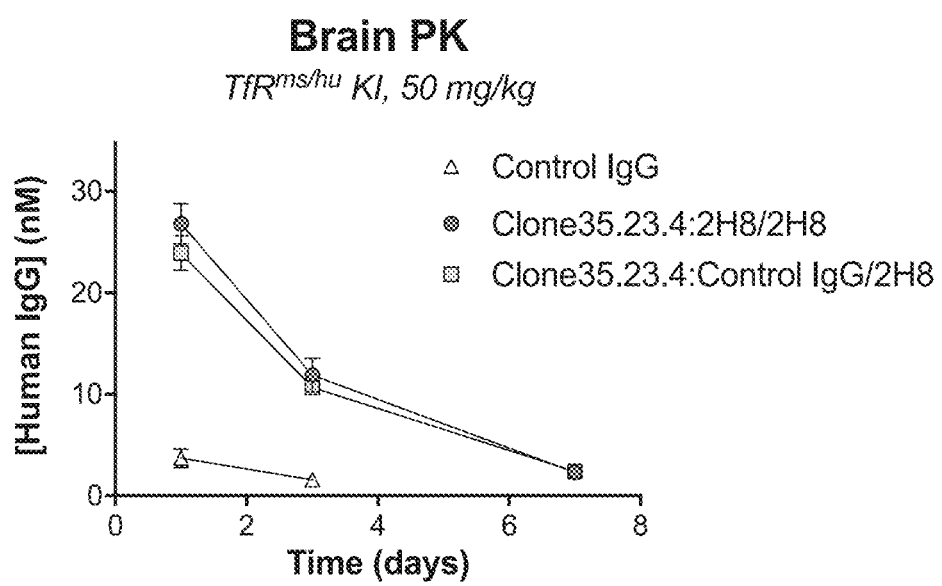

Total antibody concentrations in mouse plasma and brain lysates were quantified using a generic human Ig sandwich ELISA. A 384-well MaxiSorp plate was coated overnight with 1 μg/mL anti-huFc donkey polyclonal antibody (Jackson Immunoresearch). Following incubation with diluted plasma or NP-40 brain lysate, an anti-huFc donkey antibody conjugated to HRP (Jackson Immunoresearch) was added as the detection reagent. The standard curves for each individual molecule, from 2 nM to 2.7 pM using 3-fold dilutions, were fit using a five-parameter logistic regression. FIGS. 6A and 6B show the huIgG1 concentration in plasma and blood, respectively, at different timepoints up to 10 days for PS19/TfR$^{ms/hu}$ KI mice administered control IgG (anti-RSV antibody), Clone35.23.4:2H8/2H8, or Clone35.23.4: Control IgG (anti-RSV antibody)/2H8. As shown in FIG. 6A, the bivalent 2H8 (Clone35.23.4:2H8/2H8) and monovalent 2H8 (Clone35.23.4:Control IgG (anti-RSV)/2H8) antibodies tested in the PS19/TfR$^{ms/hu}$ KI mouse model exhibited faster clearance than the control IgG (anti-RSV antibody) due to TfR binding and target-mediated clearance. In brain, significantly higher concentrations of the bivalent 2H8 and monovalent 2H8 antibodies were detected as compared to the control IgG antibody (anti-RSV antibody) (FIG. 6B), due to TfR-mediated transcytosis at the BBB.

Figure 6C:
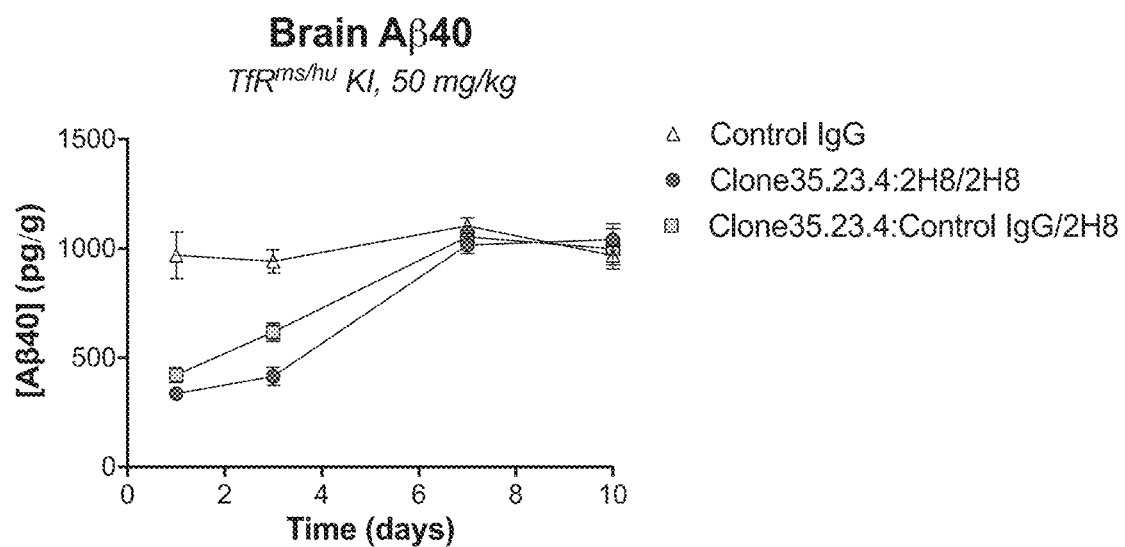
Figure 6D:
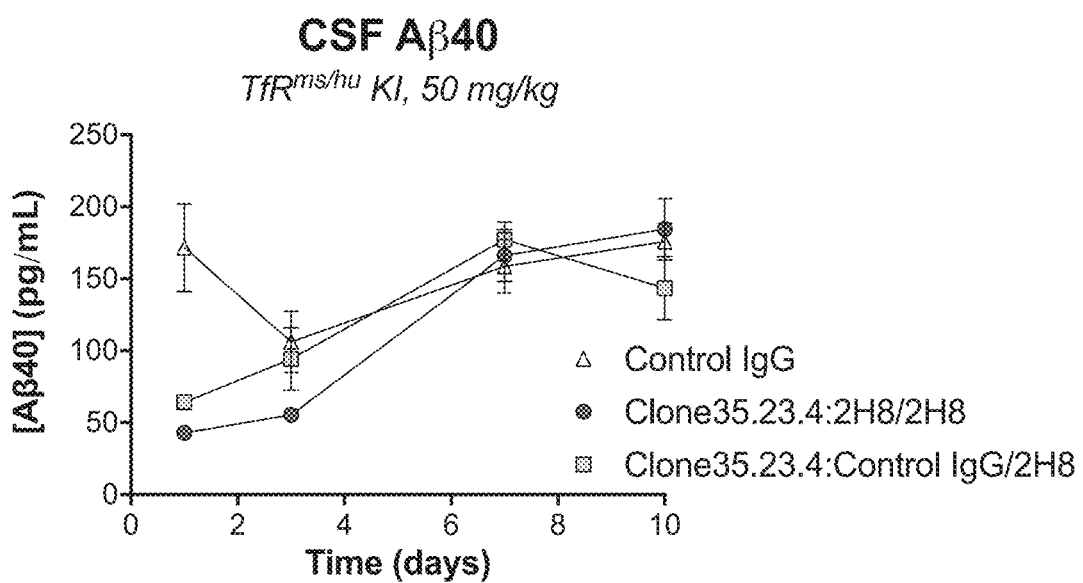

Mouse Aβ40 levels in brain lysate and CSF were measured using a sandwich ELISA. A 384-well MaxiSorp plate was coated overnight with a polyclonal capture antibody specific for the C-terminus of the A1340 peptide (Millipore #ABN240). Casein-diluted guanidine brain lysates were further diluted 1:2 on the ELISA plate and added concurrently with the detection antibody, biotinylated M3.2. CSF was analyzed at a 1:20 dilution. Samples were incubated overnight at 4° C. prior to addition of streptavidin-HRP followed by TMB substrate. The standard curve, 0.78-50 pg/mL msAβ40, was fit using a four-parameter logistic regression. FIGS. 6C and 6D show that mice dosed with either monovalent 2H8 antibody or bivalent 2H8 antibody had significantly reduced brain and CSF Aβ40 levels compared to control IgG (an anti-RSV antibody) treated mice. Bivalent Clone35.23.4:2H8/2H8 reduced CNS Aβ40 levels by 65% (brain) and 75% (CSF) compared to control IgG (anti-RSV antibody). Monovalent Clone35.23.4:control IgG (anti-RSV)/2H8 reduced Aβ40 levels by 57% (brain) and 64% (CSF).

The amino acid substitutions for each clone described in the Tables (e.g., Tables 7 and 8) dictate the amino acid substitutions at the register positions of that clone over the amino acids found in the sequence set forth in the Sequence Listing, in case of discrepancy.

It is understood that the examples and embodiments described herein are for illustrative purposes only and that various modifications or changes in light thereof will be suggested to persons skilled in the art and are to be included within the spirit and purview of this application and scope of the appended claims. The sequences of the sequence accession numbers cited herein are hereby incorporated by reference.

TABLE 7

CH3 Domain Modifications

| Clone name | Group | 384 | 385 | 386 | 387 | 388 | 389 | 390 | 391 | ... | 413 | 414 | 415 | 416 | 417 | 418 | 419 | 420 | 421 |
|---|---|---|---|---|---|---|---|---|---|---|---|---|---|---|---|---|---|---|---|
| Wild-type | n/a | N | G | Q | P | E | N | N | Y | ... | D | K | S | R | W | Q | Q | G | N |
| 1 | | L | G | L | V | W | V | G | Y | ... | A | K | S | T | W | Q | Q | G | W |
| 2 | | Y | G | T | V | W | S | H | Y | ... | S | K | S | E | W | Q | Q | G | Y |
| 3 | | Y | G | T | E | W | S | Q | Y | ... | E | K | S | D | W | Q | Q | G | H |

TABLE 7-continued

CH3 Domain Modifications

| Clone name | Group | 384 | 385 | 386 | 387 | 388 | 389 | 390 | 391 | ... | 413 | 414 | 415 | 416 | 417 | 418 | 419 | 420 | 421 |
|---|---|---|---|---|---|---|---|---|---|---|---|---|---|---|---|---|---|---|---|
| 4 |  | V | G | T | P | W | A | L | Y | ... | L | K | S | E | W | Q | Q | G | W |
| 17 | 2 | Y | G | T | V | W | S | K | Y | ... | S | K | S | E | W | Q | Q | G | F |
| 18 | 1 | L | G | H | V | W | A | V | Y | ... | P | K | S | T | W | Q | Q | G | W |
| 21 | 1 | L | G | L | V | W | V | G | Y | ... | P | K | S | T | W | Q | Q | G | W |
| 25 | 1 | M | G | H | V | W | V | G | Y | ... | D | K | S | T | W | Q | Q | G | W |
| 34 | 1 | L | G | L | V | W | V | F | S | ... | P | K | S | T | W | Q | Q | G | W |
| 35 | 2 | Y | G | T | E | W | S | S | Y | ... | T | K | S | E | W | Q | Q | G | F |
| 44 | 2 | Y | G | T | E | W | S | N | Y | ... | S | K | S | E | W | Q | Q | G | F |
| 51 | 1/2 | L | G | H | V | W | V | G | Y | ... | S | K | S | E | W | Q | Q | G | W |
| 3.1-3 | 1 | L | G | H | V | W | V | A | T | ... | P | K | S | T | W | Q | Q | G | W |
| 3.1-9 | 1 | L | G | P | V | W | V | H | T | ... | P | K | S | T | W | Q | Q | G | W |
| 3.2-5 | 1 | L | G | H | V | W | V | D | Q | ... | P | K | S | T | W | Q | Q | G | W |
| 3.2-19 | 1 | L | G | H | V | W | V | N | Q | ... | P | K | S | T | W | Q | Q | G | W |
| 3.2-1 | 1 | L | G | H | V | W | V | N | F | ... | P | K | S | T | W | Q | Q | G | W |

TABLE 8

Additional CH3 Domain Modifications

| Clone name | 378 | 379 | 380 | 381 | 382 | 383 | 384 | 385 | 386 | 387 | 388 | 389 | 390 | 391 | 392 |
|---|---|---|---|---|---|---|---|---|---|---|---|---|---|---|---|
| Wild-type | A | V | E | W | E | S | N | G | Q | P | E | N | N | Y | I |
| 35.20.1 | . | . | . | . | . | . | F | . | T | E | W | S | S | . | . |
| 35.20.2 | . | . | . | . | . | . | Y | . | T | E | W | A | S | . | . |
| 35.20.3 | . | . | . | . | . | . | Y | . | T | E | W | V | S | . | . |
| 35.20.4 | . | . | . | . | . | . | Y | . | T | E | W | S | S | . | . |
| 35.20.5 | . | . | . | . | . | . | F | . | T | E | W | A | S | . | . |
| 35.20.6 | . | . | . | . | . | . | F | . | T | E | W | V | S | . | . |
| 35.21.a.1 | . | . | W | . | . | . | F | . | T | E | W | S | S | . | . |
| 35.21.a.2 | . | . | W | . | . | . | Y | . | T | E | W | A | S | . | . |
| 35.21.a.3 | . | . | W | . | . | . | Y | . | T | E | W | V | S | . | . |
| 35.21.a.4 | . | . | W | . | . | . | Y | . | T | E | W | S | S | . | . |
| 35.21.a.5 | . | . | W | . | . | . | F | . | T | E | W | A | S | . | . |
| 35.21.a.6 | . | . | W | . | . | . | F | . | T | E | W | V | S | . | . |
| 35.23.1 | . | . | . | . | . | . | F | . | T | E | W | S | . | . | . |
| 35.23.2 | . | . | . | . | . | . | Y | . | T | E | W | A | . | . | . |
| 35.23.3 | . | . | . | . | . | . | Y | . | T | E | W | V | . | . | . |
| 35.23.4 | . | . | . | . | . | . | Y | . | T | E | W | S | . | . | . |
| 35.23.5 | . | . | . | . | . | . | F | . | T | E | W | A | . | . | . |
| 35.23.6 | . | . | . | . | . | . | F | . | T | E | W | V | . | . | . |
| 35.24.1 | . | . | W | . | . | . | F | . | T | E | W | S | . | . | . |
| 35.24.2 | . | . | W | . | . | . | Y | . | T | E | W | A | . | . | . |
| 35.24.3 | . | . | W | . | . | . | Y | . | T | E | W | V | . | . | . |
| 35.24.4 | . | . | W | . | . | . | Y | . | T | E | W | S | . | . | . |
| 35.24.5 | . | . | W | . | . | . | F | . | T | E | W | A | . | . | . |
| 35.24.6 | . | . | W | . | . | . | F | . | T | E | W | V | . | . | . |
| 35.21.17.1 | . | . | L | . | . | . | F | . | T | E | W | S | S | . | . |
| 35.21.17.2 | . | . | L | . | . | . | Y | . | T | E | W | A | S | . | . |
| 35.21.17.3 | . | . | L | . | . | . | Y | . | T | E | W | V | S | . | . |
| 35.21.17.4 | . | . | L | . | . | . | Y | . | T | E | W | S | S | . | . |
| 35.21.17.5 | . | . | L | . | . | . | F | . | T | E | W | A | S | . | . |
| 35.21.17.6 | . | . | L | . | . | . | F | . | T | E | W | V | S | . | . |
| 35.20 | . | . | . | . | . | . | Y | . | T | E | W | S | S | . | . |
| 35.21 | . | . | W | . | . | . | Y | . | T | E | W | S | S | . | . |
| 35.22 | . | . | W | . | . | . | Y | . | T | E | W | S | . | . | . |
| 35.23 | . | . | . | . | . | . | Y | . | T | E | W | S | . | . | . |
| 35.24 | . | . | W | . | . | . | Y | . | T | E | W | S | . | . | . |
| 35.21.17 | . | . | L | . | . | . | Y | . | T | E | W | S | S | . | . |
| 35.N390 | . | . | . | . | . | . | Y | . | T | E | W | S | . | . | . |

| Clone name | 411 | 412 | 413 | 414 | 415 | 416 | 417 | 418 | 419 | 420 | 421 | 422 | 423 |
|---|---|---|---|---|---|---|---|---|---|---|---|---|---|
| Wild-type | T | V | D | K | S | R | W | Q | Q | G | N | V | F |
| 35.20.1 | . | . | T | . | E | E | . | . | . | . | F | . | . |
| 35.20.2 | . | . | T | . | E | E | . | . | . | . | F | . | . |
| 35.20.3 | . | . | T | . | E | E | . | . | . | . | F | . | . |
| 35.20.4 | . | . | S | . | E | E | . | . | . | . | F | . | . |
| 35.20.5 | . | . | T | . | E | E | . | . | . | . | F | . | . |
| 35.20.6 | . | . | T | . | E | E | . | . | . | . | F | . | . |
| 35.21.a.1 | . | . | T | . | E | E | . | . | . | . | F | . | . |
| 35.21.a.2 | . | . | T | . | E | E | . | . | . | . | F | . | . |
| 35.21.a.3 | . | . | T | . | E | E | . | . | . | . | F | . | . |
| 35.21.a.4 | . | . | S | . | E | E | . | . | . | . | F | . | . |

TABLE 8-continued

Additional CH3 Domain Modifications

| | | | | | | | | | | | | | |
|---|---|---|---|---|---|---|---|---|---|---|---|---|---|
| 35.21.a.5 | . | . | T | . | E | E | . | . | . | . | F | . | . |
| 35.21.a.6 | . | . | T | . | E | E | . | . | . | . | F | . | . |
| 35.23.1 | . | . | T | . | E | E | . | . | . | . | F | . | . |
| 35.23.2 | . | . | T | . | E | E | . | . | . | . | F | . | . |
| 35.23.3 | . | . | T | . | E | E | . | . | . | . | F | . | . |
| 35.23.4 | . | . | S | . | E | E | . | . | . | . | F | . | . |
| 35.23.5 | . | . | T | . | E | E | . | . | . | . | F | . | . |
| 35.23.6 | . | . | T | . | E | E | . | . | . | . | F | . | . |
| 35.24.1 | . | . | T | . | E | E | . | . | . | . | F | . | . |
| 35.24.2 | . | . | T | . | E | E | . | . | . | . | F | . | . |
| 35.24.3 | . | . | T | . | E | E | . | . | . | . | F | . | . |
| 35.24.4 | . | . | S | . | E | E | . | . | . | . | F | . | . |
| 35.24.5 | . | . | T | . | E | E | . | . | . | . | F | . | . |
| 35.24.6 | . | . | T | . | E | E | . | . | . | . | F | . | . |
| 35.21.17.1 | . | . | T | . | E | E | . | . | . | . | F | . | . |
| 35.21.17.2 | . | . | T | . | E | E | . | . | . | . | F | . | . |
| 35.21.17.3 | . | . | T | . | E | E | . | . | . | . | F | . | . |
| 35.21.17.4 | . | . | S | . | E | E | . | . | . | . | F | . | . |
| 35.21.17.5 | . | . | T | . | E | E | . | . | . | . | F | . | . |
| 35.21.17.6 | . | . | T | . | E | E | . | . | . | . | F | . | . |
| 35.20 | . | . | T | . | E | E | . | . | . | . | F | . | . |
| 35.21 | . | . | T | . | E | E | . | . | . | . | F | . | . |
| 35.22 | . | . | T | . | . | E | . | . | . | . | F | . | . |
| 35.23 | . | . | T | . | E | E | . | . | . | . | F | . | . |
| 35.24 | . | . | T | . | E | E | . | . | . | . | F | . | . |
| 35.21.17 | . | . | T | . | E | E | . | . | . | . | F | . | . |
| 35.N390 | . | . | T | . | . | E | . | . | . | . | F | . | . |

TABLE 9

Unique Hit Sequences

| | SEQ ID NO: | | | | | | | |
|---|---|---|---|---|---|---|---|---|
| Clone | VH | CDR-H1 | CDR-H2 | CDR-H3 | VL | CDR-L1 | CDR-L2 | CDR-L3 |
| 3G10 | 1 | 29 | 51 | 78 | 101 | 129 | 145 | 158 |
| 2E1 | 2 | 30 | 52 | 79 | 102 | 130 | 146 | 159 |
| 1B4 | 3 | 31 | 53 | 80 | 103 | 131 | 147 | 160 |
| 1A12 | 4 | 32 | 54 | 81 | 104 | 132 | 148 | 161 |
| 1D7 | 5 | 33 | 55 | 82 | 105 | 133 | 147 | 162 |
| 1A5 | 6 | 34 | 56 | 83 | 106 | 134 | 149 | 163 |
| 1H6 | 7 | 35 | 57 | 84 | 107 | 135 | 148 | 164 |
| 4H10 | 8 | 36 | 58 | 85 | 108 | 136 | 150 | 165 |
| 3C11 | 9 | 37 | 59 | 86 | 109 | 137 | 151 | 159 |
| 4A4 | 10 | 38 | 60 | 87 | 110 | 133 | 147 | 166 |
| 1D2 | 11 | 36 | 61 | 88 | 111 | 138 | 150 | 167 |
| 2G7 | 12 | 39 | 62 | 89 | 112 | 138 | 152 | 168 |
| 5A4 | 13 | 40 | 63 | 90 | 113 | 138 | 153 | 169 |
| 1B1 | 14 | 41 | 64 | 91 | 114 | 138 | 152 | 170 |
| 1F1 | 15 | 42 | 65 | 92 | 115 | 139 | 148 | 171 |
| 1O6 | 16 | 34 | 66 | 93 | 116 | 134 | 149 | 172 |
| 1F7 | 17 | 43 | 67 | 94 | 117 | 140 | 154 | 173 |
| 1D10 | 18 | 44 | 68 | 95 | 118 | 141 | 155 | 174 |
| 4B1 | 19 | 45 | 69 | 96 | 119 | 142 | 156 | 175 |
| 1F8 | 20 | 45 | 70 | 97 | 120 | 138 | 152 | 168 |
| 2B8 | 21 | 46 | 71 | 98 | 121 | 138 | 152 | 176 |
| 1E7 | 22 | 45 | 71 | 98 | 114 | 138 | 152 | 170 |
| 2H8 | 23 | 47 | 72 | 99 | 122 | 143 | 146 | 159 |
| 2H8_HCvar2 | 24 | 48 | 73 | 99 | — | — | — | — |
| 2H8_HCvar3 | 25 | 49 | 74 | 99 | — | — | — | — |
| 2H8_HCvar4 | 26 | 48 | 75 | 99 | — | — | — | — |
| 2H8_HCvar5 | 27 | 48 | 76 | 99 | — | — | — | — |
| 2H8_HCvar6 | 28 | 50 | 77 | 100 | — | — | — | — |
| 2H8_LCvar2 | — | — | — | — | 123 | 138 | 146 | 177 |
| 2H8_LCvar3 | — | — | — | — | 124 | 138 | 157 | 159 |
| 2H8_LCvar4 | — | — | — | — | 125 | 138 | 152 | 159 |
| 2H8_LCvar5 | — | — | — | — | 126 | 138 | 146 | 159 |
| 2H8_LCvar6 | — | — | — | — | 127 | 130 | 146 | 159 |
| 2H8_LCvar7 | — | — | — | — | 128 | 144 | 146 | 159 |
| hu2H8_HC1 | 310 | 47 | 72 | 99 | — | — | — | — |
| hu2H8_HC2 | 311 | 47 | 72 | 99 | — | — | — | — |
| hu2H8_HC3 | 312 | 47 | 72 | 99 | — | — | — | — |
| hu2H8_HC5 | 313 | 47 | 72 | 99 | — | — | — | — |
| hu2H8_HC6 | 314 | 47 | 72 | 99 | — | — | — | — |

TABLE 9-continued

Unique Hit Sequences

| Clone | SEQ ID NO: | | | | | | | |
|---|---|---|---|---|---|---|---|---|
| | VH | CDR-H1 | CDR-H2 | CDR-H3 | VL | CDR-L1 | CDR-L2 | CDR-L3 |
| hu2H8_HC7 | 315 | 47 | 72 | 99 | — | — | — | — |
| hu2H8_LC1 | — | — | — | — | 316 | 143 | 146 | 159 |
| hu2H8_LC2 | — | — | — | — | 317 | 143 | 146 | 159 |
| hu2H8_LC3 | — | — | — | — | 318 | 143 | 146 | 159 |
| hu2H8_LC4 | — | — | — | — | 319 | 143 | 146 | 159 |
| hu2H8_LC5 | — | — | — | — | 320 | 143 | 146 | 159 |
| hu2H8_LC5.1 | — | — | — | — | 437 | 143 | 395 | 159 |
| hu2H8_LC5.2 | — | — | — | — | 438 | 143 | 396 | 159 |
| hu2H8_LC5.3 | — | — | — | — | 439 | 143 | 397 | 159 |
| hu2H8_LC5.4 | — | — | — | — | 440 | 143 | 398 | 159 |
| hu2H8_LC5.5 | — | — | — | — | 441 | 143 | 399 | 159 |
| hu2H8_LC5.6 | — | — | — | — | 442 | 143 | 400 | 159 |
| hu2H8_LC5.7 | — | — | — | — | 443 | 143 | 146 | 167 |
| hu2H8_LC5.8 | — | — | — | — | 444 | 143 | 146 | 403 |
| hu2H8_LC5.9 | — | — | — | — | 445 | 143 | 146 | 404 |
| hu2H8_LC5.10 | — | — | — | — | 446 | 143 | 146 | 405 |
| hu2H8_LC5.11 | — | — | — | — | 447 | 143 | 146 | 406 |
| hu2H8_HC6.1 | 448 | 409 | 72 | 99 | — | — | — | — |
| hu2H8_HC6.2 | 449 | 410 | 72 | 99 | — | — | — | — |
| hu2H8_HC6.3 | 450 | 411 | 72 | 99 | — | — | — | — |
| hu2H8_HC6.4 | 451 | 412 | 72 | 99 | — | — | — | — |
| hu2H8_HC6.5 | 452 | 47 | 415 | 99 | — | — | — | — |
| hu2H8_HC6.6 | 453 | 47 | 416 | 99 | — | — | — | — |
| hu2H8_HC6.7 | 454 | 47 | 417 | 99 | — | — | — | — |
| hu2H8_HC6.8 | 455 | 47 | 418 | 99 | — | — | — | — |
| hu2H8_HC6.9 | 456 | 47 | 419 | 99 | — | — | — | — |
| hu2H8_HC6.10 | 457 | 47 | 72 | 100 | — | — | — | — |
| hu2H8_HC6.11 | 458 | 47 | 72 | 423 | — | — | — | — |
| hu2H8_HC6.12 | 459 | 47 | 72 | 424 | — | — | — | — |
| hu2H8_HC6.13 | 460 | 47 | 72 | 425 | — | — | — | — |
| hu2H8_HC6.14 | 461 | 47 | 72 | 426 | — | — | — | — |
| hu2H8_HC6.15 | 462 | 47 | 72 | 427 | — | — | — | — |
| hu2H8_LC5.12 | — | — | — | — | 463 | 143 | 395 | 405 |
| hu2H8_HC6.16 | 464 | 47 | 416 | 425 | — | — | — | — |
| hu2H8_HC6.17 | 465 | 47 | 420 | 425 | — | — | — | — |

TABLE 12

Informal Sequence Listing

| SEQ ID NO: | Sequence | Description |
|---|---|---|
| 1 | EVQLQQSGAELVRPGSSVKMSCKTSGYTFTSYGMNWVKQRPGQGLEWIGYIYSANGYTE YNEKFKGKATLTSDTSSSTAYMQLSSLTSEDSAIYFCARGDYWGHGTTLTVSS | VH for clone 3G10 |
| 2 | EVQLQQPGTELVRPGTSVKLSCKASGYTFTNFWMHWVKQRPGQGLEWIGVINPSDTYTK FNQKFRGKATLTVDTSSSTAYMQLSSLTSEDSAVYFCARPTVGLDYWGQGTSVTVSS | VH for clone 2E1 |
| 3 | EVQLQQSGPELVKPGASVKISCQASDYSFTIYYLHWVKQRPGQGLEWIGWIYPGSDTNKY NEKFKDRATLTADTSSSTAYMQLSSLTSEDSAVYYCARGLDGYFTYWGQGTSVTVSS | VH for clone 1B4 |
| 4 | EVQLQQSGAELVKPGASVKLSCTASGFKIKDYYIHWMKQRTEQGLEWIGKIDPADGETTY DPKFQGKATITADTSSNTAYLQLSSLTSEDTAVYYCVRSTLVLFDYWGQGTTLTVSS | VH for clone 1A12 |
| 5 | EVKLMESGPGLVAPSQSLSISCTVSGFSLTSYGVDWVRQPPGKGLEWLGVVWGGGSTNY NSALMSRLSISKDNSKSQVFLKMNSLQTDDTAMYYCAKRDYFGGLNVWGTGTTVTVSS | VH for clone 1D7 |
| 6 | EVQLQQSGAELVKPGASVKMSCKASGYTFTSYWITWVKQRPGQGLEWIGDIYPGSGSSN NNEKFKRKATLTVDTSSSTAYMQLSSLTSEDSAVYYCARGTGTRTMDYWGQGTSVTVSS | VH for clone 1A5 |
| 7 | EIQLQQSGAELVMPGSSVKLSCTASGFSIADYYIHWLKQRTEQGLEWIGKIDPADGETKYA PKFQDKATITADTSSNTAYLQLSRLTSEDTAVYYCARTMVVERFDYWGQGTTVTVSS | VH for clone 1H6 |
| 8 | EIQLQQSGPELKKPGETVKISCKTSGYTFTTYGMTWVKQAPGKGLKWMGWINTYSGVPI YADDFKGRSAFSLETSASTAYLQINNLENEDTATYFCARRGSTAHYFDYWGQGTTVTVSS | VH for clone 4H10 |
| 9 | EVQLQQSGADLMKPGASVKLSCKATGYTFTGYWIEWVKQRPGHGLEWIGEIFPGSVSTN YNEKFKGKATFTADTSSNTAYMQLSSLTTEDSAIYYCARSPIYYDYADYWGQGTTLTVSS | VH for clone 3C11 |

TABLE 12-continued

Informal Sequence Listing

| SEQ ID NO: | Sequence | Description |
|---|---|---|
| 10 | EVKLMESGPGLVAPSQSLSITCTVSGFSLTSYPINWVRQPPGKGLEWLGVIWTGGSTNYNS ALKSRLSISRDNSKSQVFLKMNSLQTDDTARYYCARWDGYFGAFDYWGQGTTVTVSS | VH for clone 4A4 |
| 11 | EVHVKQSGPELKKPGETVTISCKASGYTFTTYGMTWVRQAPGKDLEWMGWINTHSGVPI YADDFKGRFAFSLETSAGTAYLQINNLKNEDTATYFCTRRGRLGHYFDYWGQGTSVTVSS | VH for clone 1D2 |
| 12 | EVQLVESGGGLVQPKGSLKLSCAASGFTFNTYAMHWVRQAPGKGLEWVARIRIKSKNYA TYYADSVKDRFTISRDDSQSMLYLQMNNLKTEDTAMYYCVRAYYTNYWFAYWGQGTLVTVSA | VH for clone 2G7 |
| 13 | EVQLVESGGGLVQPQGSLKLSCAASGFTFNTYDMHWVRQAPGRGLEWVGRIRSKSSNYA TYYADSVKDRFTFSRDDSQGMLYLQLNNLKTEDTAMYYCVRGIYSNYVFSYWGQGTLVTVSA | VH for clone 5A4 |
| 14 | EVQLVESGGGLVQPRGSLKLSCAASGFTFNTFAMHWVRQAPGKGLEWVARIRIKSRNYA TYYVDSVKDRFTISRDDSLNMLYLQMNNLKTEDTAMYYCVRGSYSNYWFPYWGHGTLVTVSS | VH for clone 1B1 |
| 15 | EVQLQQSGAELMKPGASVKLSCKATGYTFIGYWIDWVKQRPGHGLEWIGEILPGGGSTN HNEKFKGKATFTTDTSSNTVYMQLSSLTTEDSAIYYCAREGSYGNYYFDYWGQGTSVTVSS | VH for clone 1F1 |
| 16 | EVQLQQSGAELVKPGASVKMSCKASGYTFTSYWITWVKQRPGQGLEWIGDIYPGSGNTN YNEKFKSKATLTVDTSSSTAHMQLSSLTSEDSAVYYCARFDFGSNYAMDYWGQGTSVTVSS | VH for clone 1C6 |
| 17 | EVQLQQPGAELVKPGASVKMSCKASGYTFTSHWITWVKQRPGQGLEWIGDIYPGGGSTN YNEKFKSKATLTADTSSSTAFLQLSSLTSEDSAVYYCARWEGYDGGYFDVWGTGTSVTVSS | VH for clone 1F7 |
| 18 | EVQLKDSGPELVKPGASVKLSCKASGYTFTIHGISWVKKRNGQGLEWIGEIYPRTGNTYY NEKFKGKATLTADKSSSTAFMELHSLTSEDSAVYFCARGCYHSSPYYFDYWGQGTTVTVSS | VH for clone 1D10 |
| 19 | EVKLVESGGGLVKPGGSLKLSCAASGFTFSDYGMHWVRQAPEKGLEWVAYISSGSSTIYY ADTVKGRFTISRDNAKNTLFLQMTSLRSEDTAMYYCARGGSYGYLYYFDYWGQGTTLTVSS | VH for clone 4B1 |
| 20 | EVELMESGGGLVKPGGSLKLSCAASGFTFSDYGMHWVRQAPEKGLEWVAYISGGSNFIY YTDTVRGRFTISRDNAKNTLFLQMTSLRSEDTAMYYCARRAYYGSSYWYFDVWGTGTSVTVSS | VH for clone 1F8 |
| 21 | EVQLVESGGGLVKPGGSLKLSCAASGFTFSDYGVHWVRQAPEKGLEWVAYISGGSNFIY YTDTVKGRFTISRDNAKNTLSLQMTSLRSEDTAMYYCARRGYYGSSHWYFDVWGTGTSVTVSS | VH for clone 2B8 |
| 22 | EVQLVESGGGLVKPGGSLKLSCAASGFTFSDYGMHWVRQAPEKGLEWVAYISGGSNFIY YTDTVKGRFTISRDNAKNTLFLQMTSLRSEDTAMYYCARRGYYGSSHWYFDVWGTGTSVTVSS | VH for clone 1E7 |
| 23 | EVQLQQSGPELVKPGASVKLSCKASGYTFTNFWIHWLKQRPGQGLEWIGMIDPSDSYTKY NQKFKAKATLTVDTSSSTTYMHLSSLTSEDSAVYYCARSGVAFPYWGQRTLVTVSA | VH for clone 2H8 |
| 24 | EVQLQQPGIELVRPGTSVKLSCKASGYTFTNYWMHWIKQRPGQGLEWIGMIDPSDTYTK FNQNFKGKATLTVDTSSSTAYMQLNSLTSEDSAVYYCARSGVAFPYWGQGTTVTVSS | 2H8 VH variant 2 |
| 25 | EVQLQQSGAELVRPGTSVKLSCKASGYTFTSYWIHWVKQRPGQGLEWIGMIDPSDSYTK YNQKFKDKATLTVDTSSSTTYMHLSSLTSEDSAVYYCARSGVAFPYWGQRTLVTVSA | 2H8 VH variant 3 |
| 26 | EIQLQQSGIELVRPGTSVKLSCKASGYTFTNYWMHWVKQRPGQGLEWIGMIDPSAAYTN YNQNFKGKATLTVDTSSGTAYMQLSSLTSEDSAVYYCARSGVAFPYWGQGTTVTVSS | 2H8 VH variant 4 |
| 27 | EVQLQQPGAEVVRPGTSVKLSCKASGYTFTNYWMHWVKQRPGQGLEWIGMIDPSDNYT KYNQKLKGKATLTVDTSSSTANMHVNSLTSEDSAVYFCARSGVAFPYWGQGTLVTVSA | 2H8 VH variant 5 |
| 28 | EVQLQQSGAELVRPGTSVKLSCKASGYTFNNYWMHWVKQRPGQGLEWIGMIDPSDDDI KNNQKFKGKATLTVDTSSSTAYMQLISLTSEDSAVYYCARSGVALPYWGQGTLVTVSA | 2H8 VH variant 6 |
| 29 | GYTFTSYGMN | CDR-H1 for clone 3G10 |
| 30 | GYTFTNFWMH | CDR-H1 for clone 2E1 |
| 31 | DYSFTIYYLH | CDR-H1 for clone 1B4 |

TABLE 12-continued

Informal Sequence Listing

| SEQ ID NO: | Sequence | Description |
|---|---|---|
| 32 | GFKIKDYYIH | CDR-H1 for clone 1A12 |
| 33 | GFSLTSYGVD | CDR-H1 for clone 1D7 |
| 34 | GYTFTSYWIT | CDR-H1 for clones 1A5 and 1C6 |
| 35 | GFSIADYYIH | CDR-H1 for clone 1H6 |
| 36 | GYTFTTYGMT | CDR-H1 for clones 4H10 and 1D2 |
| 37 | GYTFTGYWIE | CDR-H1 for clone 3C11 |
| 38 | GFSLTSYPIN | CDR-H1 for clone 4A4 |
| 39 | GFTFNTYAMH | CDR-H1 for clone 2G7 |
| 40 | GFTFNTYDMH | CDR-H1 for clone 5A4 |
| 41 | GFTFNTFAMH | CDR-H1 for clone 1B1 |
| 42 | GYTFIGYWID | CDR-H1 for clone 1F1 |
| 43 | GYTFTSHWIT | CDR-H1 for clone 1F7 |
| 44 | GYTFTIHGIS | CDR-H1 for clone 1D10 |
| 45 | GFTFSDYGMH | CDR-H1 for clones 4B1, 1F8, and 1E7 |
| 46 | GFTFSDYGVH | CDR-H1 for clone 2B8 |
| 47 | GYTFTNFWIH | CDR-H1 for clone 2H8 |
| 48 | GYTFTNYWMH | CDR-H1 for 2H8 heavy chain variants 2, 4, and 5 |
| 49 | GYTFTSYWIH | CDR-H1 for 2H8 heavy chain variant 3 |
| 50 | GYTFNNYWMH | CDR-H1 for 2H8 heavy chain variant 6 |
| 51 | YIYSANGYTEYNEKFKG | CDR-H2 for clone 3G10 |
| 52 | VINPSDTYTKFNQKFRG | CDR-H2 for clone 2E1 |
| 53 | WIYPGSDTNKYNEKFKD | CDR-H2 for clone 1B4 |

TABLE 12-continued

Informal Sequence Listing

| SEQ ID NO: | Sequence | Description |
|---|---|---|
| 54 | KIDPADGETTYDPKFQG | CDR-H2 for clone 1A12 |
| 55 | VVWGGGSTNYNSALMS | CDR-H2 for clone 1D7 |
| 56 | DIYPGSGSSNNNEKFKR | CDR-H2 for clone 1A5 |
| 57 | KIDPADGETKYAPKFQD | CDR-H2 for clone 1H6 |
| 58 | WINTYSGVPIYADDFKG | CDR-H2 for clone 4H10 |
| 59 | EIFPGSVSTNYNEKFKG | CDR-H2 for clone 3C11 |
| 60 | VIWTGGSTNYNSALKS | CDR-H2 for clone 4A4 |
| 61 | WINTHSGVPIYADDFKG | CDR-H2 for clone 1D2 |
| 62 | RIRIKSKNYATYYADSVKD | CDR-H2 for clone 2G7 |
| 63 | RIRSKSSNYATYYADSVKD | CDR-H2 for clone 5A4 |
| 64 | RIRIKSRNYATYYVDSVKD | CDR-H2 for clone 1B1 |
| 65 | EILPGGGSTNHNEKFKG | CDR-H2 for clone 1F1 |
| 66 | DIYPGSGNTNYNEKFKS | CDR-H2 for clone 1C6 |
| 67 | DIYPGGGSTNYNEKFKS | CDR-H2 for clone 1F7 |
| 68 | EIYPRTGNTYYNEKFKG | CDR-H2 for clone 1D10 |
| 69 | YISSGSSTIYYADTVKG | CDR-H2 for clone 4B1 |
| 70 | YISGGSNFIYYTDTVRG | CDR-H2 for clone 1F8 |
| 71 | YISGGSNFIYYTDTVKG | CDR-H2 for clones 2B8 and 1E7 |
| 72 | MIDPSDSYTKYNQKFKA | CDR-H2 for clone 2H8 |
| 73 | MIDPSDTYTKFNQNFKG | CDR-H2 for 2H8 heavy chain variant 2 |
| 74 | MIDPSDSYTKYNQKFKD | CDR-H2 for 2H8 heavy chain variant 3 |
| 75 | MIDPSAAYTNYNQNFKG | CDR-H2 for 2H8 heavy chain variant 4 |
| 76 | MIDPSDNYTKYNQKLKG | CDR-H2 for 2H8 heavy chain variant 5 |

TABLE 12-continued

Informal Sequence Listing

| SEQ ID NO: | Sequence | Description |
|---|---|---|
| 77 | MIDPSDDDIKNNQKFKG | CDR-H2 for 2H8 heavy chain variant 6 |
| 78 | ARGDY | CDR-H3 for clone 3G10 |
| 79 | ARPTVGLDY | CDR-H3 for clone 2E1 |
| 80 | ARGLDGYFTY | CDR-H3 for clone 1B4 |
| 81 | VRSTLVLFDY | CDR-H3 for clone 1A12 |
| 82 | AKRDYFGGLNV | CDR-H3 for clone 1D7 |
| 83 | ARGTGTRTMDY | CDR-H3 for clone 1A5 |
| 84 | ARTMVVERFDY | CDR-H3 for clone 1H6 |
| 85 | ARRGSTAHYFDY | CDR-H3 for clone 4H10 |
| 86 | ARSPIYYDYADY | CDR-H3 for clone 3C11 |
| 87 | ARWDGYFGAFDY | CDR-H3 for clone 4A4 |
| 88 | TRRGRLGHYFDY | CDR-H3 for clone 1D2 |
| 89 | VRAYYTNYWFAY | CDR-H3 for clone 2G7 |
| 90 | VRGIYSNYVFSY | CDR-H3 for clone 5A4 |
| 91 | VRGSYSNYWFPY | CDR-H3 for clone 1B1 |
| 92 | AREGSYGNYYFDY | CDR-H3 for clone 1F1 |
| 93 | ARFDFGSNYAMDY | CDR-H3 for clone 1C6 |
| 94 | ARWEGYDGGYFDV | CDR-H3 for clone 1F7 |
| 95 | ARGCYHSSPYYFDY | CDR-H3 for clone 1D10 |
| 96 | ARGGSYGYLYYFDY | CDR-H3 for clone 4B1 |
| 97 | ARRAYYGSSYWYFDV | CDR-H3 for clone 1F8 |
| 98 | ARRGYYGSSHWYFDV | CDR-H3 for clones 2B8 and 1E7 |
| 99 | ARSGVAFPY | CDR-H3 for clone 2H8 and heavy chain variants 2, 3, 4, and 5 |

TABLE 12-continued

Informal Sequence Listing

| SEQ ID NO: | Sequence | Description |
|---|---|---|
| 100 | ARSGVALPY | CDR-H3 for 2H8 heavy chain variant 6 |
| 101 | DIQMNQSPSSFSASLGERVSLTCRATQEISGYLIWLQQKPDGTIKRLIYAASTLDSGVPKRF SGNRSGSDYSLTISSLESEDSADYYCLQYASYPWTFGGGTRLEIK | VL for clone 3G10 |
| 102 | DIVMTQSQKFMPTSVGDRVSVTCKASQNVGSNVAWYQQKSGQSPKALIYSASHRYSGVP DRFTGSGSGTDFTLTISNVQSEDLAEYFCQQYNSYPYTFGGGTKLEIK | VL for clone 2E1 |
| 103 | DIQMTQTTSSLSASLGDRVTISCRASQDISNYLNWYQQKPDGTVKLLIYYTSRLHSGVPSR FSGSGSGTDYSLTISNLEQEDIATYFCQQGNTLPWTFGGGTKLEIK | VL for clone 1B4 |
| 104 | DIQMTQSPLSLPVSLGDQASISCRSSQSLVHSNGYTYLHWFLQKPGQSPKLLISKVSNRFSG VPDRFSSSGSGTDFTLKITRVEAEDLGIYFCSQSTHVPYTFGGGTKLELK | VL for clone 1A12 |
| 105 | DIVMTQTTSPLSVSLGDRVTISCRASQDISKYLNWYQQRPDGTVKLLIYYTSRLHSGVPSR FSGSGSGTDYSLTISNLEQEDIATYFCHQGHKIPYTFGGGTKLELK | VL for clone 1D7 |
| 106 | DIQMTQSPATLSVTPGDRVSPSCRASQSISDYLHWYQQKSHESPRLLIKYASQSISGIPSRFS GSGSGSDFTLSINSVEPEDVGVFYCQNGHSFPFTFGAGTKLEIK | VL for clone 1A5 |
| 107 | DIQMTQTPLSLPVSLGDQASISCRSSQSLVHSNGNTYLHWYLQKPGQSPKLLIYKVSNRFS GVPDRFSGSGSGTDFTLKISRVEAEDLGVYFCSQSTHVPLTFGAGTKLELK | VL for clone 1H6 |
| 108 | DIVLTQSHKFMSTSVGDRVSITCKASQDVSTAVAWYQQKPGQSPKLLIYWASTRHTGVPD RFTGSGSGTDYTLTISSVQAEDLALYYCQQHYSTPYTFGGGTKLELK | VL for clone 4H10 |
| 109 | DIVLSQSHKFMSTSVGDRVSITCKASQDVGTAVAWYQQKPGQSPKALIYLASNRHTGVPD RFTGSGSGTDFTLTISNVQSEDLAEYFCQQYNSYPYTFGGGTRLEIK | VL for clone 3C11 |
| 110 | DIVMTQTTSSLSASLGDRVTISCRASQDISKYLNWYQQKPDGTVKLLIYYTSRLHSGVPSR FSGSGSGTDYSLTISNLEQEDIATYFCQQSLSLPYTFGGGTRLEIK | VL for clone 4A4 |
| 111 | DIVMTQSQKFMSTSVGDRVSVTCKASQNVGTNVAWYQQKPGQSPKLLIYWASTRHTGV PDRFTGSGSGTDFTLTISNVQSEDLADYFCQQYSSYPYTFGGGTKLELK | VL for clone 1D2 |
| 112 | DIVLTQSHKFMSTPVGDRVSVTCKASQNVGTNVAWYQQKPGQSPKALIYSASYRYSGVP DRFTGSGSGTDFTLTISNVQSEDLADYFCQQYSSYPLTFGSGTKLELK | VL for clone 2G7 |
| 113 | DIQMMQSQKFLSTSIGDGVSVSCKASQNVGTNVAWYQQKPGQSPTALIYSTSYRFSGVPD RFTGSGSGTDFTLTISNVQSEDLAEYFCQQYYSYPLTFGAGTKLEIK | VL for clone 5A4 |
| 114 | DIVMTQSHKFMSTSVGDRVSVTCKASQNVGTNVAWYQQKPGQSPKALIYSASYRYSGVP DRFTGSGSGADFTLTISNVQSEDLAEYFCQQYNSYPLTFGAGTKLELK | VL for clones 1B1 and 1E7 |
| 115 | DIQMTQTPLSLPVSLGDQASISCRSSQSIVHSNGNTYLEWYLQKPGQSPKLLIYKVSNRFSG VPDRFSGSGSGTDFTLKISRVEAEDLGVYYCFQGSHVPYTFGGGTKLEIK | VL for clone 1F1 |
| 116 | DIQMTQSPATLSVTPGDRISLSCRASQSISDYLHWYQQKSHESPRLLIKYASQSISGIPSRFS GSGSGSNFTLSINSVEPEDVGIYYCQNVHRFPLTFGAGTKLELK | VL for clone 1C6 |
| 117 | DIVLTQSPASLAVSLGQRATISCRASKSVSTSGYSYMHWYQQKPGQPPKLLIKYASNLESG VPARFSGSGSGTDFTLNIHHVQEEDTATYYCQHSWEIPYTFGGGTKLELK | VL for clone 1F7 |
| 118 | DIQMTQSPASLSVSVGETVTITCRASENIYSNLAWYQQKQGKSPQLLVYAATNLADGVPS RFSGSGSGTQYSLKINSLQSEDFGSYYCQHFWGTPYTFGGGTKLELK | VL for clone 1D10 |
| 119 | DIVLTQSPAIMSASPGEKVTMTCSASSSVSYMHWYQQKPGSSPKPWIFATSNLASGVPARF SGSGSGTSYSLTISRVEAEDAATYYCQQWSSKPPTFGAGTKLELK | VL for clone 4B1 |
| 120 | DIVMTQSQKFMSTSVGDRVSVTCKASQNVGTNVAWYQQKPGQSPKALIYSASYRYSGVP DRFTGSGSGTDFTLTISNVQSEDLADYFCQQYSSYPLTFGAGTKLEIK | VL for clone 1F8 |
| 121 | DIVMTQSQKFMSTSVGDRVSVTCKASQNVGTNVAWYQQKPGQSPKALIYSASYRYSGVP DRFTGSGSGTDFTLTISNVQSEDLAEYFCQQYNSYPFTFGSGTRLEIK | VL for clone 2B8 |
| 122 | DIVMTQSQKFMSKSVGDTVSVTCKASQDVGRNVAWYQQKSGQSPKSLIYSASHRYSGVP DRFTGSGSGTDFTLTISNVQSEDLAEYFCQQYNSYPYTFGGGTRLEIK | VL for clone 2H8 |
| 123 | DIVMTQSQKFMSTSVGDRVSVTCKASQNVGTNVAWYQQKPGQSPKALIYSASHRYSGVP DRFTGSGSGTDFTLTISNVQSEDLAEYFCQQYNSMYTFGGGTKLEIK | 2H8 VLvaliant 2 |

TABLE 12-continued

Informal Sequence Listing

| SEQ ID NO: | Sequence | Description |
|---|---|---|
| 124 | DIQMTQSQKFMSTSIGDRVSVTCKASQNVGTNVAWYQQKPGQSPKSLIYSASHWYSGVP DRFTGSGSGTDFTLTISNVQSEDLAEYFCQQYNSYPYTFGGGTKLEIK | 2H8 VL variant 3 |
| 125 | DIVMTQSQKFMSTSVGDRVSITCKASQNVGTNVAWYQQKPGQSPKALIYSASYRYSGVP DRFTGSGSGTDFTLTISNVQSEDLAEYFCQQYNSYPYTFGGGTKLEIK | 2H8 VL variant 4 |
| 126 | DIVMTQSQKFMSTSVGDRVSVTCKASQNVGTNVAWYQQKSGQSPKALIYSASHRYSGVP DRFTGSGSGTDFTLTISNVQSEDLAEYFCQQYNSYPYTFGGGTKLEIK | 2H8 VL variant 5 |
| 127 | DIQMTQSQKFMSKSVGDRVSVTCKASQNVGSNVAWYQQKSGQSPKSLIYSASHRYSGVP DRFTGSGSGTDFTLTISNVQSEDLADYFCQQYNSYPYTFGGGTRLEIK | 2H8 VL variant 6 |
| 128 | DILMTQSQKFMSTSVGDRVSVTCKASQNVGRNVAWYQQISGQSPKPLIYSASHRYSGVPD RFTGSGSGTDFTLTISNVQSEDLVEFFCQQYNSYPYTFGGGTKLEIK | 2H8 VL variant 7 |
| 129 | RATQEISGYLI | CDR-L1 for clone 3G10 |
| 130 | KASQNVGSNVA | CDR-L1 for clone 2E1 and 2H8 light chain variant 6 |
| 131 | QDISNYLN | CDR-L1 for clone 1B4 |
| 132 | QSLVHSNGYTYLH | CDR-L1 for clone 1A12 |
| 133 | QDISKYLN | CDR-L1 for clones 1D7 and 4A4 |
| 134 | QSISDYLH | CDR-L1 for clones 1A5 and 1C6 |
| 135 | QSLVHSNGNTYLH | CDR-L1 for clone 1H6 |
| 136 | KASQDVSTAVA | CDR-L1 for clone 4H10 |
| 137 | KASQDVGTAVA | CDR-L1 for clone 3C11 |
| 138 | KASQNVGTNVA | CDR-L1 for clones 1D2, 1B1, 1F8, 1E7, 2G7, 5A4, 2B8, and 2H8 light chain variants 2, 3, 4, and 5 |
| 139 | QSIVHSNGNTYLE | CDR-L1 for clone 1F1 |
| 140 | KSVSTSGYSYMH | CDR-L1 for clone 1F7 |
| 141 | ENIYSNLA | CDR-L1 for clone 1D10 |
| 142 | SASSSVSYMH | CDR-L1 for clone 4B1 |
| 143 | KASQDVGRNVA | CDR-L1 for clone 2H8 |
| 144 | KASQNVGRNVA | CDR-L1 for 2H8 light chain variant 7 |
| 145 | AASTLDS | CDR-L2 for clone 3G10 |

TABLE 12-continued

Informal Sequence Listing

| SEQ ID NO: | Sequence | Description |
|---|---|---|
| 146 | SASHRYS | CDR-L2 for clones 2E1, 2H8 and 2H8 light chain variants 2, 5, 6, and 7 |
| 147 | YTSRLHS | CDR-L2 for clones 1B4, 1D7, and 4A4 |
| 148 | KVSNRFS | CDR-L2 for clones 1A12, 1H6, and 1F1 |
| 149 | YASQSIS | CDR-L2 for clones 1A5 and 1C6 |
| 150 | WASTRHT | CDR-L2 for clones 4H10 and 1D2 |
| 151 | LASNRHT | CDR-L2 for clone 3C11 |
| 152 | SASYRYS | CDR-L2 for clones 2G7, 1B1, 2B8, 1F8, 1E7, and 2H8 light chain variant 4 |
| 153 | STSYRFS | CDR-L2 for clone 5A4 |
| 154 | YASNLES | CDR-L2 for clone 1F7 |
| 155 | AATNLAD | CDR-L2 for clone 1C10 |
| 156 | ATSNLAS | CDR-L2 for clone 4B1 |
| 157 | SASHWYS | CDR-L2 for 2H8 light chain variant 3 |
| 158 | LQYASYPWT | CDR-L3 for clone 3G10 |
| 159 | QQYNSYPYT | CDR-L3 for clones 2E1, 2H8, 3C11, and 2H8 light chain variants 3, 4, 5, 6, and 7 |
| 160 | QQGNTLP | CDR-L3 for clone 1B4 |
| 161 | SQSTHVPYT | CDR-L3 for clone 1A12 |
| 162 | HQGHKIPYT | CDR-L3 for clone 1D7 |
| 163 | QNGHSFPFT | CDR-L3 for clone 1A5 |
| 164 | SQSTHVPLT | CDR-L3 for clone 1H6 |

TABLE 12-continued

Informal Sequence Listing

| SEQ ID NO: | Sequence | Description |
|---|---|---|
| 165 | QQHYSTPYT | CDR-L3 for clone 4H10 |
| 166 | QQSLSLPYT | CDR-L3 for clone 4A4 |
| 167 | QQYSSYPYT | CDR-L3 for clone 1D2 and affinity matured hu2H8_LC5.7 |
| 168 | QQYSSYPLT | CDR-L3 for clones 2G7 and 1F8 |
| 169 | QQYYSYPLT | CDR-L3 for clone 5A4 |
| 170 | QQYNSYPLT | CDR-L3 for clones 1B1 and 1E7 |
| 171 | FQGSHVPYT | CDR-L3 for clone 1F1 |
| 172 | QNVHRFPLT | CDR-L3 for clone 1O6 |
| 173 | QHSWEIPYT | CDR-L3 for clone 1F7 |
| 174 | QHFWGTPYT | CDR-L3 for clone 1I0 |
| 175 | QQWSSKPPT | CDR-L3 for clone 4B1 |
| 176 | QQYNSYPFT | CDR-L3 for clone 2B8 |
| 177 | QQYNSYMYT | CDR-L3 for 2H8 light chain variant 2 |
| 178 | xRxxxxxxxFxY | CDR-H3 consensus sequence |
| 179 | KASQxVxxxVA | CDR-L1 consensus sequence |
| 180 | QSxVHSNGxTYLx | CDR-L1 consensus sequence |
| 181 | QxISxYLx | CDR-L1 consensus sequence |
| 182 | xTSxLxS | CDR-L2 consensus sequence |
| 183 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK | Clone CH3C.35.20 |
| 184 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVMHEALHNHYTQKSLSLSPGK | Clone CH3C.35.21 |

TABLE 12-continued

Informal Sequence Listing

| SEQ ID NO: | Sequence | Description |
|---|---|---|
| 185 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWSNYKTTPPVLDSDGSFFLYSKL<br>TVTKSEWQQGFVFSCSVMHEALHNHYTQKSLSLSPGK | Clone CH3C.35.22 |
| 186 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSNYKTTPPVLDSDGSFFLYSKLT<br>VTKEEWQQGFVFSCSVMHEALHNHYTQKSLSLSPGK | Clone CH3C.35.23 |
| 187 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWSNYKTTPPVLDSDGSFFLYSKL<br>TVTKEEWQQGFVFSCSVMHEALHNHYTQKSLSLSPGK | Clone CH3C.35.24 |
| 188 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVLWESYGTEWSSYKTTPPVLDSDGSFFLYSKLT<br>VTKEEWQQGFVFSCSVMHEALHNHYTQKSLSLSPGK | Clone CH3C.35.21.17 |
| 189 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESFGTEWSSYKTTPPVLDSDGSFFLYSKLT<br>VTKEEWQQGFVFSCSVMHEALHNHYTQKSLSLSPGK | Clone CH3C.35.20.1 |
| 190 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWASYKTTPPVLDSDGSFFLYSKLT<br>VTKEEWQQGFVFSCSVMHEALHNHYTQKSLSLSPGK | Clone CH3C.35.20.2 |
| 191 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWVSYKTTPPVLDSDGSFFLYSKLT<br>VTKEEWQQGFVFSCSVMHEALHNHYTQKSLSLSPGK | Clone CH3C.35.20.3 |
| 192 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSSYKTTPPVLDSDGSFFLYSKLT<br>VSKEEWQQGFVFSCSVMHEALHNHYTQKSLSLSPGK | Clone CH3C.35.20.4 |
| 193 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESFGTEWASYKTTPPVLDSDGSFFLYSKLT<br>VTKEEWQQGFVFSCSVMHEALHNHYTQKSLSLSPGK | Clone CH3C.35.20.5 |
| 194 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESFGTEWVSYKTTPPVLDSDGSFFLYSKLT<br>VTKEEWQQGFVFSCSVMHEALHNHYTQKSLSLSPGK | Clone CH3C.35.20.6 |
| 195 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESFGTEWSSYKTTPPVLDSDGSFFLYSKLT<br>VTKEEWQQGFVFSCSVMHEALHNHYTQKSLSLSPGK | Clone CH3C.35.21.a.1 |
| 196 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWASYKTTPPVLDSDGSFFLYSKL<br>TVTKEEWQQGFVFSCSVMHEALHNHYTQKSLSLSPGK | Clone CH3C.35.21.a.2 |
| 197 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWVSYKTTPPVLDSDGSFFLYSKL<br>TVTKEEWQQGFVFSCSVMHEALHNHYTQKSLSLSPGK | Clone CH3C.35.21.a.3 |
| 198 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWSSYKTTPPVLDSDGSFFLYSKLT<br>VSKEEWQQGFVFSCSVMHEALHNHYTQKSLSLSPGK | Clone CH3C.35.21.a.4 |

TABLE 12-continued

Informal Sequence Listing

| SEQ ID NO: | Sequence | Description |
|---|---|---|
| 199 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESFGTEWASYKTTPPVLDSDGSFFLYSKLT VTKEEWQQGFVFSCSVMHEALHNHYTQKSLSLSPGK | Clone CH3C.35.21.a.5 |
| 200 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESFGTEWVSYKTTPPVLDSDGSFFLYSKLT VTKEEWQQGFVFSCSVMHEALHNHYTQKSLSLSPGK | Clone CH3C.35.21.a.6 |
| 201 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWSNYKTTPPVLDSDGSFFLYSKLT VTKEEWQQGFVFSCSVMHEALHNHYTQKSLSLSPGK | Clone CH3C.35.23.1 |
| 202 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWANYKTTPPVLDSDGSFFLYSKLT VTKEEWQQGFVFSCSVMHEALHNHYTQKSLSLSPGK | Clone CH3C.35.23.2 |
| 203 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWVNYKTTPPVLDSDGSFFLYSKLT VTKEEWQQGFVFSCSVMHEALHNHYTQKSLSLSPGK | Clone CH3C.35.23.3 |
| 204 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSNYKTTPPVLDSDGSFFLYSKLT VSKEEWQQGFVFSCSVMHEALHNHYTQKSLSLSPGK | Clone CH3C.35.23.4 |
| 205 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWANYKTTPPVLDSDGSFFLYSKLT VTKEEWQQGFVFSCSVMHEALHNHYTQKSLSLSPGK | Clone CH3C.35.23.5 |
| 206 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWVNYKTTPPVLDSDGSFFLYSKLT VTKEEWQQGFVFSCSVMHEALHNHYTQKSLSLSPGK | Clone CH3C.35.23.6 |
| 207 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESFGTEWSNYKTTPPVLDSDGSFFLYSKLT VTKEEWQQGFVFSCSVMHEALHNHYTQKSLSLSPGK | Clone CH3C.35.24.1 |
| 208 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWANYKTTPPVLDSDGSFFLYSKL TVTKEEWQQGFVFSCSVMHEALHNHYTQKSLSLSPGK | Clone CH3C.35.24.2 |
| 209 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWVNYKTTPPVLDSDGSFFLYSKL TVTKEEWQQGFVFSCSVMHEALHNHYTQKSLSLSPGK | Clone CH3C.35.24.3 |
| 210 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSNYKTTPPVLDSDGSFFLYSKL TVSKEEWQQGFVFSCSVMHEALHNHYTQKSLSLSPGK | Clone CH3C.35.24.4 |
| 211 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESFGTEWANYKTTPPVLDSDGSFFLYSKL TVTKEEWQQGFVFSCSVMHEALHNHYTQKSLSLSPGK | Clone CH3C.35.24.5 |
| 212 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESFGTEWVNYKTTPPVLDSDGSFFLYSKL TVTKEEWQQGFVFSCSVMHEALHNHYTQKSLSLSPGK | Clone CH3C.35.24.6 |

TABLE 12-continued

Informal Sequence Listing

| SEQ ID NO: | Sequence | Description |
|---|---|---|
| 213 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESFGTEWSSYKTTPPVLDSDGSFFLYSKLT VTKEEWQQGFVFSCSVMHEALHNHYTQKSLSLSPGK | Clone CH3C.35.21.17.1 |
| 214 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWASYKTTPPVLDSDGSFFLYSKLT VTKEEWQQGFVFSCSVMHEALHNHYTQKSLSLSPGK | Clone CH3C.35.21.17.2 |
| 215 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWVSYKTTPPVLDSDGSFFLYSKLT VTKEEWQQGFVFSCSVMHEALHNHYTQKSLSLSPGK | Clone CH3C.35.21.17.3 |
| 216 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYKTTPPVLDSDGSFFLYSKLT VSKEEWQQGFVFSCSVMHEALHNHYTQKSLSLSPGK | Clone CH3C.35.21.17.4 |
| 217 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESFGTEWASYKTTPPVLDSDGSFFLYSKLT VTKEEWQQGFVFSCSVMHEALHNHYTQKSLSLSPGK | Clone CH3C.35.21.17.5 |
| 218 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESFGTEWVSYKTTPPVLDSDGSFFLYSKLT VTKEEWQQGFVFSCSVMHEALHNHYTQKSLSLSPGK | Clone CH3C.35.21.17.6 |
| 219 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSNYKTTPPVLDSDGSFFLYSKLT VTKSEWQQGFVFSCSVMHEALHNHYTQKSLSLSPGK | Clones CH3C.35.N390 and CH3C.35.N163 |
| 220 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESLGLVWVGYKTTPPVLDSDGSFFLYSKLT VAKSTWQQGWVFSCSVMHEALHNHYTQKSLSLSPGK | Clone CH3C.1 |
| 221 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTVWSHYKTTPPVLDSDGSFFLYSKLT VSKSEWQQGYVFSCSVMHEALHNHYTQKSLSLSPGK | Clone CH3C.2 |
| 222 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSQYKTTPPVLDSDGSFFLYSKLT VEKSDWQQGHVFSCSVMHEALHNHYTQKSLSLSPGK | Clone CH3C.3 |
| 223 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESVGTPWALYKTTPPVLDSDGSFFLYSKLT VLKSEWQQGWVFSCSVMHEALHNHYTQKSLSLSPGK | Clone CH3C.4 |
| 224 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTVWSKYKTTPPVLDSDGSFFLYSKLT VSKSEWQQGFVFSCSVMHEALHNHYTQKSLSLSPGK | Clone CH3C.17 |
| 225 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESLGHVWAVYKTTPPVLDSDGSFFLYSKL TVPKSTWQQGVVFSCSVMHEALHNHYTQKSLSLSPGK | Clone CH3C.18 |
| 226 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESLGLVWVGYKTTPPVLDSDGSFFLYSKLT VPKSTWQQGWVFSCSVMHEALHNHYTQKSLSLSPGK | Clone CH3C.21 |

TABLE 12-continued

Informal Sequence Listing

| SEQ ID NO: | Sequence | Description |
|---|---|---|
| 227 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESMGHVWVGYKTTPPVLDSDGSFFLYSKL<br>TVDKSTWQQGWVFSCSVMHEALHNHYTQKSLSLSPGK | Clone CH3C.25 |
| 228 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGLVWVFSKTTPPVLDSDGSFFLYSKLT<br>VPKSTWQQGWVFSCSVMHEALHNHYTQKSLSLSPGK | Clone CH3C.34 |
| 229 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSSYKTTPPVLDSDGSFFLYSKLT<br>VTKSEWQQGFVFSCSVMHEALHNHYTQKSLSLSPGK | Clone CH3C.35 |
| 230 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSNYKTTPPVLDSDGSFFLYSKLT<br>VSKSEWQQGFVFSCSVMHEALHNHYTQKSLSLSPGK | Clone CH3C.44 |
| 231 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWVGYKTTPPVLDSDGSFFLYSKL<br>TVSKSEWQQGWVFSCSVMHEALHNHYTQKSLSLSPGK | Clone CH3C.51 |
| 232 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWVATKTTPPVLDSDGSFFLYSKLT<br>VPKSTWQQGWVFSCSVMHEALHNHYTQKSLSLSPGK | Clone CH3C.3.1-3 |
| 233 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGPVWVHTKTTPPVLDSDGSFFLYSKLT<br>VPKSTWQQGWVFSCSVMHEALHNHYTQKSLSLSPGK | Clone CH3C.3.1-9 |
| 234 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWVDQKTTPPVLDSDGSFFLYSKL<br>TVPKSTWQQGWVFSCSVMHEALHNHYTQKSLSLSPGK | Clone CH3C.3.2-5 |
| 235 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWVNQKTTPPVLDSDGSFFLYSKL<br>TVPKSTWQQGWVFSCSVMHEALHNHYTQKSLSLSPGK | Clone CH3C.3.2-19 |
| 236 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWVNFKTTPPVLDSDGSFFLYSKLT<br>VPKSTWQQGWVFSCSVMHEALHNHYTQKSLSLSPGK | Clone CH3C.3.2-1 |
| 237 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWAVYKTTPPVLDSDGSFFLYSKL<br>TVPKSTWQQGWVFSCSVMHEALHNHYTQKSLSLSPGK | Clone CH3C.18 valiant |
| 238 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVLWESLGHVWAVYKTTPPVLDSDGSFFLYSKL<br>TVPKSTWQQGWVFSCSVMHEALHNHYTQKSLSLSPGK | Clone CH3C.18 valiant |
| 239 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVYWESLGHVWAVYKTTPPVLDSDGSFFLYSKL<br>TVPKSTWQQGWVFSCSVMHEALHNHYTQKSLSLSPGK | Clone CH3C.18 valiant |
| 240 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWAVYQTTPPVLDSDGSFFLYSKL<br>TVPKSTWQQGWVFSCSVMHEALHNHYTQKSLSLSPGK | Clone CH3C.18 valiant |

TABLE 12-continued

Informal Sequence Listing

| SEQ ID NO: | Sequence | Description |
|---|---|---|
| 241 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWAVYFTTPPVLDSDGSFFLYSKLT<br>VPKSTWQQGWVFSCSVMHEALHNHYTQKSLSLSPGK | Clone CH3C.18 variant |
| 242 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWAVYHTTPPVLDSDGSFFLYSKL<br>TVPKSTWQQGWVFSCSVMHEALHNHYTQKSLSLSPGK | Clone CH3C.18 variant |
| 243 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWAVYKTTPPVLDSDGSFFLYSKL<br>TVPKSTWQQGWVFSCSVMHEALHNHYTQKSLSLSPGK | Clone CH3C.35.13 |
| 244 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESLGHVWAVYQTTPPVLDSDGSFFLYSKL<br>TVPKSTWQQGWVFSCSVMHEALHNHYTQKSLSLSPGK | Clone CH3C.35.14 |
| 245 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWAVYQTTPPVLDSDGSFFLYSKL<br>TVPKSTWQQGWVFSCSVMHEALHNHYTQKSLSLSPGK | Clone CH3C.35.15 |
| 246 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWVNQKTTPPVLDSDGSFFLYSKL<br>TVPKSTWQQGWVFSCSVMHEALHNHYTQKSLSLSPGK | Clone CH3C.35.16 |
| 247 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWVNQTTPPVLDSDGSFFLYSKL<br>TVPKSTWQQGWVFSCSVMHEALHNHYTQKSLSLSPGK | Clone CH3C.35.17 |
| 248 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESLGHVWVNQTTPPVLDSDGSFFLYSKL<br>TVPKSTWQQGWVFSCSVMHEALHNHYTQKSLSLSPGK | Clone CH3C.35.18 |
| 249 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVWWESYGTEWSSYKTTPPVLDSDGSFFLYSKLT<br>VTKSEWQQGFVFSCSVMHEALHNHYTQKSLSLSPGK | Clone CH3C.35.19 |
| 250 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSSYQTTPPVLDSDGSFFLYSKLT<br>VTKSEWQQGFVFSCSVMHEALHNHYTQKSLSLSPGK | Clone CH3C.35.K165Q |
| 251 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWSNYQTTPPVLDSDGSFFLYSKLT<br>VTKSEWQQGFVFSCSVMHEALHNHYTQKSLSLSPGK | Clone CH3C.35.N163.K165Q |
| 252 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVLWESYGTEWSSYKTTPPVLDSDGSFFLYSKLT<br>VTKSEWQQGFVFSCSVMHEALHNHYTQKSLSLSPGK | Clone CH3C.35.21.1 |
| 253 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVLWESYGTEWSSYRTTPPVLDSDGSFFLYSKLT<br>VTKSEWQQGFVFSCSVMHEALHNHYTQKSLSLSPGK | Clone CH3C.35.21.2 |
| 254 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVLWESYGTEWSSYRTTPPVLDSDGSFFLYSKLT<br>VTREEWQQGFVFSCSVMHEALHNHYTQKSLSLSPGK | Clone CH3C.35.21.3 |

TABLE 12-continued

Informal Sequence Listing

| SEQ ID NO: | Sequence | Description |
|---|---|---|
| 255 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTGEEWQQGFVFSCSVMHEALHNHYTQKSLSLSPGK | Clone CH3C.35.21.4 |
| 256 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTREEWQQGFVFSCWVMHEALHNHYTQKSLSLSPGK | Clone CH3C.35.21.5 |
| 257 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTKEEWQQGFVFSCWVMHEALHNHYTQKSLSLSPGK | Clone CH3C.35.21.6 |
| 258 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTREEWQQGFVFTCWVMHEALHNHYTQKSLSLSPGK | Clone CH3C.35.21.7 |
| 259 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTREEWQQGFVFTCGVMHEALHNHYTQKSLSLSPGK | Clone CH3C.35.21.8 |
| 260 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTREEWQQGFVFECWVMHEALHNHYTQKSLSLSPGK | Clone CH3C.35.21.9 |
| 261 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTREEWQQGFVFKCWVMHEALHNHYTQKSLSLSPGK | Clone CH3C.35.21.10 |
| 262 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWSSYRTTPPVLDSDGSFFLYSKLT VTPEEWQQGFVFKCWVMHEALHNHYTQKSLSLSPGK | Clone CH3C.35.21.11 |
| 263 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSSYRTTPPVLDSDGSFFLYSKLT VTREEWQQGFVFSCSVMHEALHNHYTQKSLSLSPGK | Clone CH3C.35.21.12 |
| 264 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSSYRTTPPVLDSDGSFFLYSKLT VTGEEWQQGFVFSCSVMHEALHNHYTQKSLSLSPGK | Clone CH3C.35.21.13 |
| 265 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSSYRTTPPVLDSDGSFFLYSKLT VTREEWQQGFVFTCWVMHEALHNHYTQKSLSLSPGK | Clone CH3C.35.21.14 |
| 266 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSSYRTTPPVLDSDGSFFLYSKLT VTGEEWQQGFVFTCWVMHEALHNHYTQKSLSLSPGK | Clone CH3C.35.21.15 |
| 267 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVWWESYGTEWSSYRTTPPVLDSDGSFFLYSKLT VTREEWQQGFVFTCGVMHEALHNHYTQKSLSLSPGK | Clone CH3C.35.21.16 |

TABLE 12-continued

Informal Sequence Listing

| SEQ ID NO: | Sequence | Description |
|---|---|---|
| 268 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCSVMHEALHNHYTQKSLSLSPGK | Clone CH3C.35.21.18 |
| 269 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK | Clone CH3C.35.21 with knob mutation |
| 270 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK | Clone CH3C.35.21 with knob and LALA mutations |
| 271 | APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK | Clone CH3C.35.21 with knob and YTE mutations |
| 272 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK | Clone CH3C.35.21 with knob, LALA, and YTE mutations |
| 273 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK | Clone CH3C.35.21 with hole mutations |
| 274 | APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK | Clone CH3C.35.21 with hole and LALA mutations |
| 275 | APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK | Clone CH3C.35.21 with hole and YTE mutations |
| 276 | APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK | Clone CH3C.35.21 with hole, LALA, and YTE mutations |
| 277 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK | Clone CH3B.1 |
| 278 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK | Clone CH3B.2 |
| 279 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK | Clone CH3B.3 |
| 280 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK | Clone CH3B.4 |
| 281 | APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFELVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK | Clone CH3B.5 |

TABLE 12-continued

Informal Sequence Listing

| SEQ ID NO: | Sequence | Description |
|---|---|---|
| 282 | APELLGGPSVFLFPPKPKDTLMISRTPEVTCVVVDVSHEDPEVEFIWYVDGVDVRYEWQL PREEQYNSTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVMHEALHNHYTQKSLSLSPGK | Clone CH2A2.1 |
| 283 | APELLGGPSVFLFPPKPKDTLMISRTPEVTCVVVDVSHEDPEVGFVVVYVDGVPVSWEWY WPREEQYNSTYRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2A2.2 |
| 284 | APELLGGPSVFLFPPKPKDTLMISRTPEVTCVVVDVSHEDPEVQFDWYVDGVMVRREWH RPREEQYNSTYRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2A2.3 |
| 285 | APELLGGPSVFLFPPKPKDTLMISRTPEVTCVVVDVSHEDPEVSFEWYVDGVPVRWEWQ WPREEQYNSTYRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2A2.4 |
| 286 | APELLGGPSVFLFPPKPKDTLMISRTPEVTCVVVDVSHEDPEVAFTWYVDGVPVRWEWQ NPREEQYNSTYRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2A2.5 |
| 287 | APELLGGPSVFLFPPKPKDTLMISRTPEVTCVVVDPQTPPWEVKFNWYVDGVEVHNAKTK PREEYYTTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVMHEALHNHYTQKSLSLSPGK | Clone CH2C.1 |
| 288 | APELLGGPSVFLFPPKPKDTLMISRTPEVTCVVVDPPSPPWEVKFNWYVDGVEVHNAKTK PREEYYSNYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVMHEALHNHYTQKSLSLSPGK | Clone CH2C.2 |
| 289 | APELLGGPSVFLFPPKPKDTLMISRTPEVTCVVVDPQTPPWEVKFNWYVDGVEVHNAKTK PREEYYSNYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVMHEALHNHYTQKSLSLSPGK | Clone CH2C.3 |
| 290 | APELLGGPSVFLFPPKPKDTLMISRTPEVTCVVVDFRGPPWEVKFNWYVDGVEVHNAKT KPREEEYYHDYRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2C.4 |
| 291 | APELLGGPSVFLFPPKPKDTLMISRTPEVTCVVVDPQTVPWEVKFNWYVDGVEVHNAKT KPREEEYYSNYRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2C.5 |
| 292 | APELLGGPSVFLFPPKPKDTLMISRTPEVTCVVVDVSVPPRMVKFNWYVDGVEVHNAKT KSLTSQHNSTVRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2D.1 |
| 293 | APELLGGPSVFLFPPKPKDTLMISRTPEVTCVVVDVSVPPWMVKFNWYVDGVEVHNAKT KSLTSQHNSTVRVVSVLTVLHQDWLNGKEYKCKVSNKALPAPIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2D.2 |
| 294 | APELLGGPSVFLFPPKPKDTLMISRTPEVTCVVVDVSDMVVEYVKFNWYVDGVEVHNAKT KPWVKQLNSTWRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2D.3 |
| 295 | APELLGGPSVFLFPPKPKDTLMISRTPEVTCVVVDVSDDWTVKFNWYVDGVEVHNAKT KPWIAQPNSTWRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2D.4 |

TABLE 12-continued

Informal Sequence Listing

| SEQ ID NO: | Sequence | Description |
|---|---|---|
| 296 | APELLGGPSVFLFPPKPKDTLMISRTPEVTCVVVDVSDDWEWVKFNWYVDGVEVHNAKT KPWKLQLNSTWRVVSVLTVLHQDWLNGKEYKCKVSNKALPAPIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2D.5 |
| 297 | APELLGGPSVFLFPPKPKDTLMISRTPEVTCVVVDVSHEDPWVVVFYWYVDGVEVHNAKT KPREEQYNSTYRVVSVLTVLHQDWLNGKEYKCSVVNIALWWSIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2E3.1 |
| 298 | APELLGGPSVFLFPPKPKDTLMISRTPEVTCVVVDVSHEDPVVGFRWYVDGVEVHNAKTK PREEQYNSTYRVVSVLTVLHQDWLNGKEYKCRVSNSALTWKIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2E3.2 |
| 299 | APELLGGPSVFLFPPKPKDTLMISRTPEVTCVVVDVSHEDPVVGFRWYVDGVEVHNAKTK PREEQYNSTYRVVSVLTVLHQDWLNGKEYKCRVSNSALSWRIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2E3.3 |
| 300 | APELLGGPSVFLFPPKPKDTLMISRTPEVTCVVVDVSHEDPIVGFRWYVDGVEVHNAKTK PREEQYNSTYRVVSVLTVLHQDWLNGKEYKCRVSNSALRWRIEKTISKAKGQPREPQVY TLPPSRDELTKNQVSLTCLVKGFYPSDIAVEWESNGQPENNYKTTPPVLDSDGSFFLYSKL TVDKSRWQQGNVFSCSVMHEALHNHYTQKSLSLSPGK | Clone CH2E3.4 |
| 301 | APELLGGPSVFLFPPKPKDTLMISRTPEVTCVVVDVSHEDPAVGFEWYVDGVEVHNAKTK PREEQYNSTYRVVSVLTVLHQDWLNGKEYKCQVFNWALDWVIEKTISKAKGQPREPQV YTLPPSRDELTKNQVSLTCLVKGFYPSDIAVEWESNGQPENNYKTTPPVLDSDGSFFLYSK LTVDKSRWQQGNVFSCSVMHEALHNHYTQKSLSLSPGK | Clone CH2E3.5 |
| 302 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVMHEALHNHYTQKSLSLSPGK | Wild-type human Fc sequence positions 231-447 EU index numbering |
| 303 | MMDQARSAFSNLFGGEPLSYTRFSLARQVDGDNSHVEMKLAVDEEENADNNTKANVTK PKRCSGSICYGTIAVIVFFLIGFMIGYLGYCKGVEPKTECERLAGTESPVREEPGEDFPAAR RLYWDDLKRKLSEKLDSTDFTGTIKLLNENSYVPREAGSQKDENLALYVENQFREFKLSK VWRDQHFVKIQVKDSAQNSVIIVDKNGRLVYLVENPGGYVAYSKAATVTGKLVHANFG TKKDFEDLYTPVNGSIVIVRAGKITFAEKVANAESLNAIGVLIYMDQTKFPIVNAELSFFGH AHLGTGDPYTPGFPSFNHTQFPPPSRSSGLPNIPVQTISRAAAEKLFGNMEGDCPSDWKTDS TCRMVTSESKNVKLTVSNVLKEIKILNIFGVIKGFVEPDHYVVVGAQRDAWGPGAAKSGV GTALLLKLAQMFSDMVLKDGFQPSRSIIIFASWSAGDFGSVGATEWLEGYLSSLHLKAFTY INLDKAVLGTSNFKVSASPLLYTLIEKTMQNVKHPVTGQFLYQDSNWASKVEKLTLDNA AFPPFLAYSGIPAVSFCFCEDTDYPYLGTTMDTYKELIERIPELNKVARAAAEVAGQFVIKLT HDVELNLDYERYNSQLLSFVRDLNQYRADIKEMGLSLQWLYSARGDFFRATSRLTTDFG NAEKTDRFVMKKLNDRVMRVEYHFLSPYVSPKESPFRHVFWGSGSHTLPALLENLKLRK QNNGAFNETLFRNQLALATWTIQGAANALSGDVWDIDNEF | Human transferrin receptor protein 1 (TFR1) |
| 304 | EPKSCDKTHTCPPCP | Human IgG1 hinge sequence |
| 305 | MAQALPWLLLWMGAGVLPAHGTQHGIRLPLRSGLGGAPLGLRLPRETDEEPEEPGRRGS FVEMVDNLRGKSGQGYYVEMTVGSPPQTLNILVDTGSSNFAVGAAPHPFLHRYYQRQLS STYRDLRKGVYVPYTQGKWEGELGTDLVSIPHGPNVTVRANIAAITESDKFFINGSNWEGI LGLAYAEIARPDDSLEPFFDSLVKQTHVPNLFSLQLCGAGFPLNQSEVLASVGGSMIIGGID HSLYTGSLWYTPIRREWYYEVIIVRVEINGQDLKMDCKEYNYDKSIVDSGTTNLRLPKKV FEAAVKSIKAASSTEKFPDGFWLGEQLVCWQAGTTPWNIFPVISLYLMGEVTNQSFRITILP QQYLRPVEDVATSQDDCYKFAISQSSTGTVMGAVIMEGFYVVFDRARKRIGFAVSACHV HDEFRTAAVEGPFVTLDMEDCGYNIPQTDESTLMTIAYVMAAICALFMLPLCLMVCQWR CLRCLRQQHDDFADDISLLK | Full-length human BACE1 (signal peptide underlined) |
| 306 | TQHGIRLPLRSGLGGAPLGLRLPRETDEEPEEPGRRGSFVEMVDNLRGKSGQGYYVEMTV GSPPQTLNILVDTGSSNFAVGAAPHPFLHRYYQRQLSSTYRDLRKGVYVPYTQGKWEGEL GTDLVSIPHGPNVTVRANIAAITESDKFFINGSNWEGILGLAYAEIARPDDSLEPFFDSLVK QTHVPNLFSLQLCGAGFPLNQSEVLASVGGSMIIGGIDHSLYTGSLWYTPIRREWYYEVIIV RVEINGQDLKMDCKEYNYDKSIVDSGTTNLRLPKKVFEAAVKSIKAASSTEKFPDGFWLG EQLVCWQAGTTPWNIFPVISLYLMGEVTNQSFRITILPQQYLRPVEDVATSQDDCYKFAIS QSSTGTVMGAVIMEGFYVVFDRARKRIGFAVSACHVHDEFRTAAVEGPFVTLDMEDCGY NIPQTDESTLMTIAYVMAAICALFMLPLCLMVCQWRCLRCLRQQHDDFADDISLLK | Pro form of BACE1 (lacking signal peptide) |

TABLE 12-continued

Informal Sequence Listing

| SEQ ID NO: | Sequence | Description |
|---|---|---|
| 307 | ETDEEPEEPGRRGSFVEMVDNLRGKSGQGYYVEMTVGSPPQTLNILVDTGSSNFAVGAAP HPFLHRYYQRQLSSTYRDLRKGVYPYTQGKWEGELGTDLVSIPHGPNVTVRANIAAITE SDKFFINGSNWEGILGLAYAEIARPDDSLEPFFDSLVKQTHVPNLFSLQLCGAGFPLNQSEV LASVGGSMIIGGIDHSLYTGSLWYTPIRREWYYEVIIVRVEINGQDLKMDCKEYNYDKSIV DSGTTNLRLPKKVFEAAVKSIKAASSTEKFPDGFWLGEQLVCWQAGTTPWNIFPVISLYL MGEVTNQSFRITILPQQYLRPVEDVATSQDDCYKFAISQSSTGTVMGAVIMEGFYVVFDR ARKRIGFAVSACHVHDEFRTAAVEGPFVTLDMEDCGYNIPQTDESTLMTIAYVMAAICAL FMLPLCLMVCQWRCLRCLRQQHDDFADDISLLK | Mature full-length human BACE1 |
| 308 | YxTEWSS | CH3C motif |
| 309 | TxxExxxxF | CH3C motif |
| 310 | QVQLVQSGAEVKKPGASVKVSCKASGYTFTNFWIHWVRQAPGQGLEWMGMIDPSDSYT KYNQKFKARVTMTRDTSTSTTYMELSSLRSEDTAVYYCARSGVAFPYWGQGTLVTVSS | hu2H8_HC1 |
| 311 | QVQLVQSGAEVKKPGASVKVSCKASGYTFTNFWIHWLRQAPGQGLEWMGMIDPSDSYT KYNQKFKARVTMTRDTSTSTTYMELSSLRSEDTAVYYCARSGVAFPYWGQGTLVTVSS | hu2H8_HC2 |
| 312 | QVQLVQSGAEVKKPGASVKVSCKASGYTFTNFWIHWLRQAPGQGLEWMGMIDPSDSYT KYNQKFKARVTMTVDTSTSTTYMELSSLRSEDTAVYYCARSGVAFPYWGQGTLVTVSS | hu2H8_HC3 |
| 313 | QVQLVQSGAEVKKPGASVKVSCKASGYTFTNFWIHWVRQAPGQGLEWMGMIDPSDSYT KYNQKFKARATLTRDTSTSTVYMELSSLRSEDTAVYYCARSGVAFPYWGQGTLVTVSS | hu2H8_HC5 |
| 314 | QVQLVQSGAEVKKPGASVKVSCKASGYTFTNFWIHWLRQAPGQGLEWMGMIDPSDSYT KYNQKFKARATLTVDTSTSTVYMELSSLRSEDTAVYYCARSGVAFPYWGQGTLVTVSS | hu2H8_HC6 |
| 315 | QVQLVQSGAEVKKPGASVKVSCKASGYTFTNFWIHWLRQAPGQGLEWMGMIDPSDSYT KYNQKFKARATLTVDTSTSTTYMELSSLRSEDTAVYYCARSGVAFPYWGQGTLVTVSS | hu2H8_HC7 |
| 316 | DIQMTQSPSSLSASVGDRVTITCKASQDVGRNVAWYQQKPGKAPKLLIYSASHRYSGVPS RFSGSGSGTDFTLTISSLQPEDFATYYCQQYNSYPYTFGQGTKVEIK | hu2H8_LC1 |
| 317 | DIQMTQSPSSLSASVGDRVTITCKASQDVGRNVAWYQQKPGKSPKLLIYSASHRYSGVPS RFSGSGSGTDFTLTISSLQPEDFATYYCQQYNSYPYTFGQGTKVEIK | hu2H8_LC2 |
| 318 | DIQMTQSPSSLSASVGDRVTITCKASQDVGRNVAWYQQKPGKAPKSLIYSASHRYSGVPS RFSGSGSGTDFTLTISSLQPEDFATYYCQQYNSYPYTFGQGTKVEIK | hu2H8_LC3 |
| 319 | DIQMTQSPSSLSASVGDRVTITCKASQDVGRNVAWYQQKPGKSPKSLIYSASHRYSGVPS RFSGSGSGTDFTLTISSLQPEDFATYYCQQYNSYPYTFGQGTKVEIK | hu2H8_LC4 |
| 320 | DIQMTQSPSSLSASVGDRVTITCKASQDVGRNVAWYQQKPGKSPKSLIYSASHRYSGVPS RFSGSGSGTDFTLTISSLQPEDFATYYCQQYNSYPYTFGQGTKVEIK | hu2H8_LC5 |
| 321 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSSYKTTPPVLDSDGSFFLYSKLT VTKEEWQQGFVFSCSVMHEALHNHYTQKSLSLSPGK | Clone CH3C.35.20.1 with knob mutation |
| 322 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSSYKTTPPVLDSDGSFFLYSK LTVTKEEWQQGFVFSCSVMHEALHNHYTQKSLSLSPGK | Clone CH3C.35.20.1 with knob and LALA mutations |
| 323 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSSYKTTPPVLDSDGSFFLYSK LTVTKEEWQQGFVFSCSVMHEALHNHYTQKSLSLSPGK | Clone CH3C.35.20.1 with knob and LALAPG mutations |
| 324 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSSYKTTPPVLDSDGSFFLYSKLT VTKEEWQQGFVFSCSVMHEALHNHYTQKSLSLSPGK | Clone CH3C.35.20.1 with knob and YTE mutations |
| 325 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSSYKTTPPVLDSDGSFFLYSK LTVTKEEWQQGFVFSCSVMHEALHNHYTQKSLSLSPGK | Clone CH3C.35.20.1 with knob, LALA, and YTE mutations |

TABLE 12-continued

Informal Sequence Listing

| SEQ ID NO: | Sequence | Description |
|---|---|---|
| 326 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSSYKTTPPVLDSDGSFFLYSK LTVTKEEWQQGFVFSCSVMHEALHNHYTQKSLSLSPGK | Clone CH3C.35.20.1 with knob, LALAPG, and YTE mutations |
| 327 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFGTEWSSYKTTPPVLDSDGSFFLVSKLT VTKEEWQQGFVFSCSVMHEALHNHYTQKSLSLSPGK | Clone CH3C.35.20.1 with hole mutations |
| 328 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFGTEWSSYKTTPPVLDSDGSFFLVSK LTVTKEEWQQGFVFSCSVMHEALHNHYTQKSLSLSPGK | Clone CH3C.35.20.1 with hole and LALA mutations |
| 329 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFGTEWSSYKTTPPVLDSDGSFFLVSK LTVTKEEWQQGFVFSCSVMHEALHNHYTQKSLSLSPGK | Clone CH3C.35.20.1 with hole and LALAPG mutations |
| 330 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFGTEWSSYKTTPPVLDSDGSFFLVSKLT VTKEEWQQGFVFSCSVMHEALHNHYTQKSLSLSPGK | Clone CH3C.35.20.1 with hole and YTE mutations |
| 331 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFGTEWSSYKTTPPVLDSDGSFFLVSK LTVTKEEWQQGFVFSCSVMHEALHNHYTQKSLSLSPGK | Clone CH3C.35.20.1 with hole, LALA, and YTE mutations |
| 332 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFGTEWSSYKTTPPVLDSDGSFFLVSK LTVTKEEWQQGFVFSCSVMHEALHNHYTQKSLSLSPGK | Clone CH3C.35.20.1 with hole, LALAPG, and YTE mutations |
| 333 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWANYKTTPPVLDSDGSFFLYSKL TVTKEEWQQGFVFSCSVMHEALHNHYTQKSLSLSPGK | Clone CH3C.35.23.2 with knob mutation |
| 334 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWANYKTTPPVLDSDGSFFLYS KLTVTKEEWQQGFVFSCSVMHEALHNHYTQKSLSLSPGK | Clone CH3C.35.23.2 with knob and LALA mutations |
| 335 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWANYKTTPPVLDSDGSFFLYS KLTVTKEEWQQGFVFSCSVMHEALHNHYTQKSLSLSPGKLALAPG | Clone CH3C.35.23.2 with knob and LALAPG mutations |
| 336 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWANYKTTPPVLDSDGSFFLYSKL TVTKEEWQQGFVFSCSVMHEALHNHYTQKSLSLSPGK | Clone CH3C.35.23.2 with knob and YTE mutations |
| 337 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWANYKTTPPVLDSDGSFFLYS KLTVTKEEWQQGFVFSCSVMHEALHNHYTQKSLSLSPGK | Clone CH3C.35.23.2 with knob, LALA, and YTE mutations |
| 338 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWANYKTTPPVLDSDGSFFLYS KLTVTKEEWQQGFVFSCSVMHEALHNHYTQKSLSLSPGK | Clone CH3C.35.23.2 with knob, LALAPG, and YTE mutations |

TABLE 12-continued

Informal Sequence Listing

| SEQ ID NO: | Sequence | Description |
|---|---|---|
| 339 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLSCAVKGFYPSDIAVEWESYGTEWANYKTTPPVLDSDGSFFLVSKLT<br>VTKEEWQQGFVFSCSVMHEALHNHYTQKSLSLSPGK | Clone CH3C.35.23.2 with hole mutations |
| 340 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLSCAVKGFYPSDIAVEWESYGTEWANYKTTPPVLDSDGSFFLVS<br>KLTVTKEEWQQGFVFSCSVMHEALHNHYTQKSLSLSPGK | Clone CH3C.35.23.2 with hole and LALA mutations |
| 341 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLSCAVKGFYPSDIAVEWESYGTEWANYKTTPPVLDSDGSFFLVS<br>KLTVTKEEWQQGFVFSCSVMHEALHNHYTQKSLSLSPGK | Clone CH3C.35.23.2 with hole and LALAPG mutations |
| 342 | APELLGGPSVFLFPPKPKDTLYITREPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLSCAVKGFYPSDIAVEWESYGTEWANYKTTPPVLDSDGSFFLVSKLT<br>VTKEEWQQGFVFSCSVMHEALHNHYTQKSLSLSPGK | Clone CH3C.35.23.2 with hole and YTE mutations |
| 343 | APEAAGGPSVFLFPPKPKDTLYITREPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLSCAVKGFYPSDIAVEWESYGTEWANYKTTPPVLDSDGSFFLVS<br>KLTVTKEEWQQGFVFSCSVMHEALHNHYTQKSLSLSPGK | Clone CH3C.35.23.2 with hole, LALA, and YTE mutations |
| 344 | APEAAGGPSVFLFPPKPKDTLYITREPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLSCAVKGFYPSDIAVEWESYGTEWANYKTTPPVLDSDGSFFLVS<br>KLTVTKEEWQQGFVFSCSVMHEALHNHYTQKSLSLSPGK | Clone CH3C.35.23.2 with hole, LALAPG, and YTE mutations |
| 345 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLWCLVKGFYPSDIAVEWESYGTEWVNYKTTPPVLDSDGSFFLYSKL<br>TVTKEEWQQGFVFSCSVMHEALHNHYTQKSLSLSPGK | Clone CH3C.35.23.3 with knob mutation |
| 346 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLWCLVKGFYPSDIAVEWESYGTEWVNYKTTPPVLDSDGSFFLYS<br>KLTVTKEEWQQGFVFSCSVMHEALHNHYTQKSLSLSPGK | Clone CH3C.35.23.3 with knob and LALA mutations |
| 347 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLWCLVKGFYPSDIAVEWESYGTEWVNYKTTPPVLDSDGSFFLYS<br>KLTVTKEEWQQGFVFSCSVMHEALHNHYTQKSLSLSPGK | Clone CH3C.35.23.3 with knob and LALAPG mutations |
| 348 | APELLGGPSVFLFPPKPKDTLYITREPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLWCLVKGFYPSDIAVEWESYGTEWVNYKTTPPVLDSDGSFFLYSKL<br>TVTKEEWQQGFVFSCSVMHEALHNHYTQKSLSLSPGK | Clone CH3C.35.23.3 with knob and YTE mutations |
| 349 | APEAAGGPSVFLFPPKPKDTLYITREPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLWCLVKGFYPSDIAVEWESYGTEWVNYKTTPPVLDSDGSFFLYS<br>KLTVTKEEWQQGFVFSCSVMHEALHNHYTQKSLSLSPGK | Clone CH3C.35.23.3 with knob, LALA, and YTE mutations |
| 350 | APEAAGGPSVFLFPPKPKDTLYITREPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLWCLVKGFYPSDIAVEWESYGTEWVNYKTTPPVLDSDGSFFLYS<br>KLTVTKEEWQQGFVFSCSVMHEALHNHYTQKSLSLSPGK | Clone CH3C.35.23.3 with knob, LALAPG, and YTE mutations |
| 351 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLSCAVKGFYPSDIAVEWESYGTEWVNYKTTPPVLDSDGSFFLVSKLT<br>VTKEEWQQGFVFSCSVMHEALHNHYTQKSLSLSPGK | Clone CH3C.35.23.3 with hole mutations |

TABLE 12-continued

Informal Sequence Listing

| SEQ ID NO: | Sequence | Description |
|---|---|---|
| 352 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVMHEALHNHYTQKSLSLSPGK | Clone CH3C.35.23.3 with hole and LALA mutations |
| 353 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVMHEALHNHYTQKSLSLSPGK | Clone CH3C.35.23.3 with hole and LALAPG mutations |
| 354 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWVNYKTTPPVLDSDGSFFLVSKLT VTKEEWQQGFVFSCSVMHEALHNHYTQKSLSLSPGK | Clone CH3C.35.23.3 with hole and YTE mutations |
| 355 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVMHEALHNHYTQKSLSLSPGK | Clone CH3C.35.23.3 with hole, LALA, and YTE mutations |
| 356 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVMHEALHNHYTQKSLSLSPGK | Clone CH3C.35.23.3 with hole, LALAPG, and YTE mutations |
| 357 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVSKEEWQQGFVFSCSVMHEALHNHYTQKSLSLSPGK | Clone CH3C.35.23.4 with knob mutation |
| 358 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVMHEALHNHYTQKSLSLSPGK | Clone CH3C.35.23.4 with knob and LALA mutations |
| 359 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVMHEALHNHYTQKSLSLSPGK | Clone CH3C.35.23.4 with knob and LALAPG mutations |
| 360 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVSKEEWQQGFVFSCSVMHEALHNHYTQKSLSLSPGK | Clone CH3C.35.23.4 with knob and YTE mutations |
| 361 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVMHEALHNHYTQKSLSLSPGK | Clone CH3C.35.23.4 with knob, LALA, and YTE mutations |
| 362 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVMHEALHNHYTQKSLSLSPGK | Clone CH3C.35.23.4 with knob, LALAPG, and YTE mutations |
| 363 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VSKEEWQQGFVFSCSVMHEALHNHYTQKSLSLSPGK | Clone CH3C.35.23.4 with hole mutations |
| 364 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVMHEALHNHYTQKSLSLSPGK | Clone CH3C.35.23.4 with hole and LALA mutations |

TABLE 12-continued

Informal Sequence Listing

| SEQ ID NO: | Sequence | Description |
|---|---|---|
| 365 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVMHEALHNHYTQKSLSLSPGK | Clone CH3C.35.23.4 with hole and LALAPG mutations |
| 366 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VSKEEWQQGFVFSCSVMHEALHNHYTQKSLSLSPGK | Clone CH3C.35.23.4 with hole and YTE mutations |
| 367 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVMHEALHNHYTQKSLSLSPGK | Clone CH3C.35.23.4 with hole, LALA, and YTE mutations |
| 368 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVMHEALHNHYTQKSLSLSPGK | Clone CH3C.35.23.4 with hole, LALAPG, and YTE mutations |
| 369 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVLWESYGTEWASYKTTPPVLDSDGSFFLYSKL TVTKEEWQQGFVFSCSVMHEALHNHYTQKSLSLSPGK | Clone CH3C.35.21.17.2 with knob mutation |
| 370 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVMHEALHNHYTQKSLSLSPGK | Clone CH3C.35.21.17.2 with knob and LALA mutations |
| 371 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVMHEALHNHYTQKSLSLSPGKLALAPG | Clone CH3C.35.21.17.2 with knob and LALAPG mutations |
| 372 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVLWESYGTEWASYKTTPPVLDSDGSFFLYSKL TVTKEEWQQGFVFSCSVMHEALHNHYTQKSLSLSPGK | Clone CH3C.35.21.17.2 with knob and YTE mutations |
| 373 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVMHEALHNHYTQKSLSLSPGK | Clone CH3C.35.21.17.2 with knob, LALA, and YTE mutations |
| 374 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVMHEALHNHYTQKSLSLSPGK | Clone CH3C.35.21.17.2 with knob, LALAPG, and YTE mutations |
| 375 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVLWESYGTEWASYKTTPPVLDSDGSFFLVSKLT VTKEEWQQGFVFSCSVMHEALHNHYTQKSLSLSPGK | Clone CH3C.35.21.17.2 with hole mutations |
| 376 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVMHEALHNHYTQKSLSLSPGK | Clone CH3C.35.21.17.2 with hole and LALA mutations |
| 377 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVMHEALHNHYTQKSLSLSPGK | Clone CH3C.35.21.17.2 with hole and LALAPG mutations |

TABLE 12-continued

Informal Sequence Listing

| SEQ ID NO: | Sequence | Description |
|---|---|---|
| 378 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVLWESYGTEWASYKTTPPVLDSDGSFFLVSKLT VTKEEWQQGFVFSCSVMHEALHNHYTQKSLSLSPGK | Clone CH3C.35.21.17.2 with hole and YTE mutations |
| 379 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVMHEALHNHYTQKSLSLSPGK | Clone CH3C.35.21.17.2 with hole, LALA, and YTE mutations |
| 380 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVMHEALHNHYTQKSLSLSPGK | Clone CH3C.35.21.17.2 with hole, LALAPG, and YTE mutations |
| 381 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVTKEEWQQGFVFSCSVMHEALHNHYTQKSLSLSPGK | Clone CH3C.35.23 with knob mutation |
| 382 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVMHEALHNHYTQKSLSLSPGK | Clone CH3C.35.23 with knob and LALA mutations |
| 383 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVMHEALHNHYTQKSLSLSPGKLALAPG | Clone CH3C.35.23 with knob and LALAPG mutations |
| 384 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVTKEEWQQGFVFSCSVMHEALHNHYTQKSLSLSPGK | Clone CH3C.35.23 with knob and YTE mutations |
| 385 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVMHEALHNHYTQKSLSLSPGK | Clone CH3C.35.23 with knob, LALA, and YTE mutations |
| 386 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVMHEALHNHYTQKSLSLSPGK | Clone CH3C.35.23 with knob, LALAPG, and YTE mutations |
| 387 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VTKEEWQQGFVFSCSVMHEALHNHYTQKSLSLSPGK | Clone CH3C.35.23 with hole mutations |
| 388 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVMHEALHNHYTQKSLSLSPGK | Clone CH3C.35.23 with hole and LALA mutations |
| 389 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVMHEALHNHYTQKSLSLSPGK | Clone CH3C.35.23 with hole and LALAPG mutations |
| 390 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VTKEEWQQGFVFSCSVMHEALHNHYTQKSLSLSPGK | Clone CH3C.35.23 with hole and YTE mutations |
| 391 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVMHEALHNHYTQKSLSLSPGK | Clone CH3C.35.23 with hole, LALA, and YTE mutations |

TABLE 12-continued

Informal Sequence Listing

| SEQ ID NO: | Sequence | Description |
|---|---|---|
| 392 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVMHEALHNHYTQKSLSLSPGK | Clone CH3C.35.23 with hole, LALAPG, and YTE mutations |
| 393 | KASQxVGxNVA | 2H8 CDR-L1 consensus sequence |
| 394 | KASQX$_1$VGX$_2$NVA wherein X$_1$ is D or N and X$_2$ is R, S, or T | 2H8 CDR-L1 consensus sequence |
| 395 | SASHYYS | hu2H8_LC5.1 and hu2H8_LC5.12 CDR-L2 sequence |
| 396 | SASHNYS | hu2H8_LC5.2 CDR-L2 sequence |
| 397 | SASHMYS | hu2H8_LC5.3 CDR-L2 sequence |
| 398 | SASHQYS | hu2H8_LC5.4 CDR-L2 sequence |
| 399 | SASHKYS | hu2H8_LC5.5 CDR-L2 sequence |
| 400 | SASHLYS | hu2H8_LC5.6 CDR-L2 sequence |
| 401 | SASxxYS | 2H8 CDR-L2 consensus sequence |
| 402 | SASX$_1$X$_2$YS wherein X$_1$ is H or Y and X$_2$ is R, Y, N, M, Q, K, L, or W | 2H8 CDR-L2 consensus sequence |
| 403 | QQYQSYPYT | hu2H8_LC5.8 CDR-L3 sequence |
| 404 | QQYNAYPYT | hu2H8_LC5.9 CDR-L3 sequence |
| 405 | QQYYSYPYT | hu2H8_LC5.10 and hu2H8_LC5.12 CDR-L3 sequence |
| 406 | QQYYSYAYT | hu2H8_LC5.11 CDR-L3 sequence |
| 407 | QQYxxYxYT | 2H8 CDR-L3 consensus sequence |
| 408 | QQYX$_1$X$_2$YX$_3$YT wherein X$_1$ is N, S, Q, or Y; X$_2$ is S or A; and X$_3$ is P, A, or M | 2H8 CDR-L3 consensus sequence |
| 409 | GYTFNNFWIH | hu2H8_HC6.1 CDR-H1 sequence |
| 410 | GYTFTNYWIH | hu2H8_HC6.2 CDR-H1 sequence |
| 411 | GYTFNSYWIH | hu2H8_HC6.3 CDR-H1 sequence |

TABLE 12-continued

Informal Sequence Listing

| SEQ ID NO: | Sequence | Description |
|---|---|---|
| 412 | GYTFTNFYIH | hu2H8_HC6.4 CDR-H1 sequence |
| 413 | GYTFxxxxxH | 2H8 CDR-H1 consensus sequence |
| 414 | GYTFX$_1$X$_2$X$_3$X$_4$X$_5$H wherein X$_1$ is T or N; X$_2$ is N or S; X$_3$ is F or Y; X$_4$ is W or Y; and X$_5$ is I or M | 2H8 CDR-H1 consensus sequence |
| 415 | IIDPSDSYTKYNQKFKA | hu2H8_HC6.5 CDR-H2 sequence |
| 416 | MIDPSSSYTKYNQKFKA | hu2H8_HC6.6 and hu2H8_HC6.16 CDR-H2 sequence |
| 417 | MIDPSESYTKYNQKFKA | hu2H8_HC6.7 CDR-H2 sequence |
| 418 | MIDPSGSYTKYNQKFKA | hu2H8_HC6.8 CDR-H2 sequence |
| 419 | MIDPSDAYTKYNQKFKA | hu2H8_HC6.9 CDR-H2 sequence |
| 420 | MIDPDSSYTKYNQKFKA | hu2H8_HC6.17 CDR-H2 sequence |
| 421 | xIDPxxxxxxxNQxxKx | 2H8 CDR-H2 consensus sequence |
| 422 | X$_1$IDPX$_2$X$_3$X$_4$X$_5$X$_6$X$_7$X$_8$NQX$_9$X$_{10}$KX$_{11}$ wherein X$_1$ is M or I; X$_2$ is S or D; X$_3$ is D, S, E, G, or A; X$_4$ is S, A, T, N, or D; X$_5$ is Y or D; X$_6$ is T or I; X$_7$ is K or N; X$_8$ is Y, F, or N; X$_9$ is K or N; X$_{10}$ is F or L; and X$_{11}$ is A, G, or D | 2H8 CDR-H2 consensus sequence |
| 423 | ARSGVALPS | hu2H8_HC6.11 CDR-H3 sequence |
| 424 | ARSGVSLPY | hu2H8_HC6.12 CDR-H3 sequence |
| 425 | ARSGASLPY | hu2H8_HC6.13, hu2H8_HC6.16, and hu2H8_HC6.17 CDR-H3 sequence |
| 426 | ARSGAALPY | hu2H8_HC6.14 CDR-H3 sequence |
| 427 | ARSGGALPY | hu2H8_HC6.15 CDR-H3 sequence |
| 428 | ARSGxxxPx | 2H8 CDR-H3 consensus sequence |

TABLE 12-continued

Informal Sequence Listing

| SEQ ID NO: | Sequence | Description |
|---|---|---|
| 429 | ARSGX$_1$X$_2$X$_3$PX$_4$ wherein X$_1$ is V, A, or G; X$_2$ is A or S; X$_3$ is F or L; and X$_4$ is Y or S | 2H8 CDR-H3 consensus sequence |
| 430 | SASHxYS | 2H8 CDR-L2 consensus sequence |
| 431 | SASHX$_1$YS wherein X$_1$ is R, Y, N, M, Q, K, or L | 2H8 CDR-L2 consensus sequence |
| 432 | QQYX$_1$X$_2$YX$_3$YT wherein X$_1$ is N, S, Q, or Y; X$_2$ is S or A; and X$_3$ is P or A | 2H8 CDR-L3 consensus sequence |
| 433 | GYTFxxxxIH | 2H8 CDR-H1 consensus sequence |
| 434 | GYTFX$_1$X$_2$X$_3$X$_4$IH wherein X$_1$ is T or N; X$_2$ is N or S; X$_3$ is F or Y; and X$_4$ is W or Y | 2H8 CDR-H1 consensus sequence |
| 435 | xIDPxxxYTKYNQKFKA | 2H8 CDR-H2 consensus sequence |
| 436 | X$_1$IDPX$_2$X$_3$X$_4$YTKYNQKFKA wherein X$_1$ is M or I; X$_2$ is S or D; X$_3$ is D, S, E, or G; and X$_4$ is S or A | 2H8 CDR-H2 consensus sequence |
| 437 | DIQMTQSPSSLSASVGDRVTITCKASQDVGRNVAWYQQKPGKSPKSLIYSASHYYSGVPS RFSGSGSGTDFTLTISSLQPEDFATYFCQQYNSYPYTFGQGTKVEIK | hu2H8_LC5.1 |
| 438 | DIQMTQSPSSLSASVGDRVTITCKASQDVGRNVAWYQQKPGKSPKSLIYSASHNYSGVPS RFSGSGSGTDFTLTISSLQPEDFATYFCQQYNSYPYTFGQGTKVEIK | hu2H8_LC5.2 |
| 439 | DIQMTQSPSSLSASVGDRVTITCKASQDVGRNVAWYQQKPGKSPKSLIYSASHMYSGVPS RFSGSGSGTDFTLTISSLQPEDFATYFCQQYNSYPYTFGQGTKVEIK | hu2H8_LC5.3 |
| 440 | DIQMTQSPSSLSASVGDRVTITCKASQDVGRNVAWYQQKPGKSPKSLIYSASHQYSGVPS RFSGSGSGTDFTLTISSLQPEDFATYFCQQYNSYPYTFGQGTKVEIK | hu2H8_LC5.4 |
| 441 | DIQMTQSPSSLSASVGDRVTITCKASQDVGRNVAWYQQKPGKSPKSLIYSASHKYSGVPS RFSGSGSGTDFTLTISSLQPEDFATYFCQQYNSYPYTFGQGTKVEIK | hu2H8_LC5.5 |
| 442 | DIQMTQSPSSLSASVGDRVTITCKASQDVGRNVAWYQQKPGKSPKSLIYSASHLYSGVPS RFSGSGSGTDFTLTISSLQPEDFATYFCQQYNSYPYTFGQGTKVEIK | hu2H8_LC5.6 |
| 443 | DIQMTQSPSSLSASVGDRVTITCKASQDVGRNVAWYQQKPGKSPKSLIYSASHRYSGVPS RFSGSGSGTDFTLTISSLQPEDFATYFCQQYSSYPYTFGQGTKVEIK | hu2H8_LC5.7 |
| 444 | DIQMTQSPSSLSASVGDRVTITCKASQDVGRNVAWYQQKPGKSPKSLIYSASHRYSGVPS RFSGSGSGTDFTLTISSLQPEDFATYFCQQYQSYPYTFGQGTKVEIK | hu2H8_LC5.8 |
| 445 | DIQMTQSPSSLSASVGDRVTITCKASQDVGRNVAWYQQKPGKSPKSLIYSASHRYSGVPS RFSGSGSGTDFTLTISSLQPEDFATYFCQQYNAYPYTFGQGTKVEIK | hu2H8_LC5.9 |
| 446 | DIQMTQSPSSLSASVGDRVTITCKASQDVGRNVAWYQQKPGKSPKSLIYSASHRYSGVPS RFSGSGSGTDFTLTISSLQPEDFATYFCQQYYSYPYTFGQGTKVEIK | hu2H8_LC5.10 |
| 447 | DIQMTQSPSSLSASVGDRVTITCKASQDVGRNVAWYQQKPGKSPKSLIYSASHRYSGVPS RFSGSGSGTDFTLTISSLQPEDFATYFCQQYYSYAYTFGQGTKVEIK | hu2H8_LC5.11 |
| 448 | QVQLVQSGAEVKKPGASVKVSCKASGYTFNNFWIHWVRQAPGQGLEWMGMIDPSDSYT KYNQKFKARATLTVDTSTSTVYMELSSLRSEDTAVYYCARSGVAFPYWGQGTLVTVSS | hu2H8_HC6.1 |
| 449 | QVQLVQSGAEVKKPGASVKVSCKASGYTFTNYWIHWVRQAPGQGLEWMGMIDPSDSYT KYNQKFKARATLTVDTSTSTVYMELSSLRSEDTAVYYCARSGVAFPYWGQGTLVTVSS | hu2H8_HC6.2 |
| 450 | QVQLVQSGAEVKKPGASVKVSCKASGYTFNSYWIHWVRQAPGQGLEWMGMIDPSDSYT KYNQKFKARATLTVDTSTSTVYMELSSLRSEDTAVYYCARSGVAFPYWGQGTLVTVSS | hu2H8_HC6.3 |

TABLE 12-continued

Informal Sequence Listing

| SEQ ID NO: | Sequence | Description |
|---|---|---|
| 451 | QVQLVQSGAEVKKPGASVKVSCKASGYTFTNFYIHWVRQAPGQGLEWMGMIDPSDSYT KYNQKFKARATLTVDTSTSTVYMELSSLRSEDTAVYYCARSGVAFPYWGQGTLVTVSS | hu2H8_HC6.4 |
| 452 | QVQLVQSGAEVKKPGASVKVSCKASGYTFTNFWIHWVRQAPGQGLEWMGMIDPSDSYTK YNQKFKARATLTVDTSTSTVYMELSSLRSEDTAVYYCARSGVAFPYWGQGTLVTVSS | hu2H8_HC6.5 |
| 453 | QVQLVQSGAEVKKPGASVKVSCKASGYTFTNFWIHWVRQAPGQGLEWMGMIDPSSSYT KYNQKFKARATLTVDTSTSTVYMELSSLRSEDTAVYYCARSGVAFPYWGQGTLVTVSS | hu2H8_HC6.6 |
| 454 | QVQLVQSGAEVKKPGASVKVSCKASGYTFTNFWIHWVRQAPGQGLEWMGMIDPSESYT KYNQKFKARATLTVDTSTSTVYMELSSLRSEDTAVYYCARSGVAFPYWGQGTLVTVSS | hu2H8_HC6.7 |
| 455 | QVQLVQSGAEVKKPGASVKVSCKASGYTFTNFWIHWVRQAPGQGLEWMGMIDPSGSYT KYNQKFKARATLTVDTSTSTVYMELSSLRSEDTAVYYCARSGVAFPYWGQGTLVTVSS | hu2H8_HC6.8 |
| 456 | QVQLVQSGAEVKKPGASVKVSCKASGYTFTNFWIHWVRQAPGQGLEWMGMIDPSDAYT KYNQKFKARATLTVDTSTSTVYMELSSLRSEDTAVYYCARSGVAFPYWGQGTLVTVSS | hu2H8_HC6.9 |
| 457 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGVALPYWGQGTLVTVSS | hu2H8_HC6.10 |
| 458 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGVALPSWGQGTLVTVSS | hu2H8_HC6.11 |
| 459 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGVSLPYWGQGTLVTVSS | hu2H8_HC6.12 |
| 460 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGASLPYWGQGTLVTVSS | hu2H8_HC6.13 |
| 461 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGAALPYWGQGTLVTVSS | hu2H8_HC6.14 |
| 462 | QVQLVQSGAEVKKPGASVKVSCKASGYTFTNFWIHWVRQAPGQGLEWMGMIDPSDSYT KYNQKFKARATLTVDTSTSTVYMELSSLRSEDTAVYYCARSGGALPYWGQGTLVTVSS | hu2H8_HC6.15 |
| 463 | DIQMTQSPSSLSASVGDRVTITCKASQDVGRNVAWYQQKPGKSPKSLIYSASHYYSGVPS RFSGSGSGTDFTLTISSLQPEDFATYFCQQYYSYPYTFGQGTKVEIK | hu2H8_LC5.12 |
| 464 | QVQLVQSGAEVKKPGASVKVSCKASGYTFTNFWIHWVRQAPGQGLEWMGMIDPSSSYT KYNQKFKARATLTVDTSTSTVYMELSSLRSEDTAVYYCARSGASLPYWGQGTLVTVSS | hu2H8_HC6.16 |
| 465 | QVQLVQSGAEVKKPGASVKVSCKASGYTFTNFWIHWVRQAPGQGLEWMGMIDPDSSYT KYNQKFKARATLTVDTSTSTVYMELSSLRSEDTAVYYCARSGASLPYWGQGTLVTVSS | hu2H8_HC6.17 |
| 466 | $X_1RX_2X_3X_4X_5X_6X_7X_8FX_9Y$ wherein $X_1$ is V or T; $X_2$ is G, A, or R; $X_3$ is G, Y, I, or S; $X_4$ is Y or R; $X_5$ is S, T, or L; $X_6$ is N or G; $X_7$ is Y or H; $X_8$ is W, V, or Y; and $X_9$ is D, A, S, or P | CDR-H3 consensus sequence |
| 467 | $KASQX_1VX_2X_3X_4VA$ wherein $X_1$ is D or N; $X_2$ is G or S; $X_3$ is T, R, or S; and $X_4$ is N or A | CDR-L1 consensus sequence |
| 468 | $QSX_1VHSNGX_2TYLX_3$ wherein $X_1$ is L or I; $X_2$ is N or Y; and $X_3$ is H or E | CDR-L1 consensus sequence |
| 469 | $QX_1ISX_2YLX_3$ wherein $X_1$ is D or S; $X_2$ is N, K, or D; and $X_3$ is N or H | CDR-L1 consensus sequence |
| 470 | $X_1TSX_2LX_3S$ wherein $X_1$ is Y or A; $X_2$ is N or R; and $X_3$ is H or A | CDR-L2 consensus sequence |
| 471 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWSSYKTTPPVLDSDGSFFLYSKLT VSKEEWQQGFVFSCSVMHEALHNHYTQKSLSLSPGK | Clone CH3C.35.20.1.1 |

TABLE 12-continued

Informal Sequence Listing

| SEQ ID NO: | Sequence | Description |
|---|---|---|
| 472 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWANYKTTPPVLDSDGSFFLYSKLT VSKSEWQQGFVFSCSVMHEALHNHYTQKSLSLSPGK | Clone CH3C.35.23.2.1 |
| 473 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWSNYKTTPPVLDSDGSFFLYSKLT VSKEEWQQGFVFSCSVMHEALHNHYTQKSLSLSPGK | Clone CH3C.35.23.1.1 |
| 474 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSSYKTTPPVLDSDGSFFLYSKLT VSKSEWQQGFVFSCSVMHEALHNHYTQKSLSLSPGK | Clone CH3C.35.S413 |
| 475 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWVNYKTTPPVLDSDGSFFLYSKLT VSKEEWQQGFVFSCSVMHEALHNHYTQKSLSLSPGK | Clone CH3C.35.23.3.1 |
| 476 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSNYKTTPPVLDSDGSFFLYSKLT VSKSEWQQGFVFSCSVMHEALHNHYTQKSLSLSPGK | Clone CH3C.35.N390.1 |
| 477 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWVNYKTTPPVLDSDGSFFLYSKLT VSKEEWQQGFVFSCSVMHEALHNHYTQKSLSLSPGK | Clone CH3C.35.23.6.1 |
| 478 | PCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVMHEALHNHYTQKSLSLSPGK | Clone CH3C.35.21 with knob mutation |
| 479 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVMHEALHNHYTQKSLSLSPGK | Clone CH3C.35.21 with knob and LALA mutations |
| 480 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLWCLVKGFYPSDIAVWWESYGTEWSSYKTTPPVLDSDGSFFL YSKLTVTKEEWQQGFVFSCSVMHEALHNHYTQKSLSLSPGKLALAPG | Clone CH3C.35.21 with knob and mutations |
| 481 | PCPAPELLGGPSVFLFPPKPKDTLYITREPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVMHEALHNHYTQKSLSLSPGK | Clone CH3C.35.21 with knob and YTE mutations |
| 482 | PCPAPEAAGGPSVFLFPPKPKDTLYITREPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVMHEALHNHYTQKSLSLSPGK | Clone CH3C.35.21 with knob, LALA, and YTE mutations |
| 483 | PCPAPEAAGGPSVFLFPPKPKDTLYITREPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLWCLVKGFYPSDIAVWWESYGTEWSSYKTTPPVLDSDGSFFL YSKLTVTKEEWQQGFVFSCSVMHEALHNHYTQKSLSLSPGK | Clone CH3C.35.21 with knob, LALAPG, and YTE mutations |
| 484 | PCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVMHEALHNHYTQKSLSLSPGK | Clone CH3C.35.21 with hole mutations |
| 485 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVMHEALHNHYTQKSLSLSPGK | Clone CH3C.35.21 with hole and LALA mutations |

TABLE 12-continued

Informal Sequence Listing

| SEQ ID NO: | Sequence | Description |
|---|---|---|
| 486 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLSCAVKGFYPSDIAVWWESYGTEWSSYKTTPPVLDSDGSFFL VSKLTVTKEEWQQGFVFSCSVMHEALHNHYTQKSLSLSPGKLALAPG | Clone CH3C.35.21 with hole and mutations |
| 487 | PCPAPELLGGPSVFLFPPKPKDTLYITREPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVMHEALHNHYTQKSLSLSPGK | Clone CH3C.35.21 with hole and YTE mutations |
| 488 | PCPAPEAAGGPSVFLFPPKPKDTLYITREPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVMHEALHNHYTQKSLSLSPGK | Clone CH3C.35.21 with hole, LALA, and YTE mutations |
| 489 | PCPAPEAAGGPSVFLFPPKPKDTLYITREPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLSCAVKGFYPSDIAVWWESYGTEWSSYKTTPPVLDSDGSFFL VSKLTVTKEEWQQGFVFSCSVMHEALHNHYTQKSLSLSPGK | Clone CH3C.35.21 with hole, LALAPG, and YTE mutations |
| 490 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFG1EWSSYKTTPPVLDSDGSFFLYSKLT VSKEEWQQGFVFSCSVMHEALHNHYTQKSLSLSPGK | Clone CH3C.35.20.1.1 with knob mutation |
| 491 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFG1EWSSYKTTPPVLDSDGSFFLYSK LTVSKEEWQQGFVFSCSVMHEALHNHYTQKSLSLSPGK | Clone CH3C.35.20.1.1 with knob and LALA mutations |
| 492 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSSYKTTPPVLDSDGSFFLYSK LTVSKEEWQQGFVFSCSVMHEALHNHYTQKSLSLSPGKLALAPG | Clone CH3C.35.20.1.1 with knob and mutations |
| 493 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFG1EWSSYKTTPPVLDSDGSFFLYSKLT VSKEEWQQGFVFSCSVMHEALHNHYTQKSLSLSPGK | Clone CH3C.35.20.1.1 with knob and YIEmutations |
| 494 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSSYKTTPPVLDSDGSFFLYSK LTVSKEEWQQGFVFSCSVMHEALHNHYTQKSLSLSPGK | Clone CH3C.35.20.1.1 with knob, LALA, and YIE mutations |
| 495 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSSYKTTPPVLDSDGSFFLYSK LTVSKEEWQQGFVFSCSVMHEALHNHYTQKSLSLSPGK | Clone CH3C.35.20.1.1 with knob, LALAPG, and YIEmutations |
| 496 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFG1EWSSYKTTPPVLDSDGSFFLVSKLT VSKEEWQQGFVFSCSVMHEALHNHYTQKSLSLSPGK | Clone CH3C.35.20.1.1 with hole mutations |
| 497 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFG1EWSSYKTTPPVLDSDGSFFLVSK LTVSKEEWQQGFVFSCSVMHEALHNHYTQKSLSLSPGK | Clone CH3C.35.20.1.1 with hole and LALA mutations |
| 498 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFG1EWSSYKTTPPVLDSDGSFFLVSK LTVSKEEWQQGFVFSCSVMHEALHNHYTQKSLSLSPGK | Clone CH3C.35.20.1.1 with hole and LALAPG mutations |
| 499 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFG1EWSSYKTTPPVLDSDGSFFLVSKLT VSKEEWQQGFVFSCSVMHEALHNHYTQKSLSLSPGK | Clone CH3C.35.20.1.1 with hole and YTE mutations |

TABLE 12-continued

Informal Sequence Listing

| SEQ ID NO: | Sequence | Description |
|---|---|---|
| 500 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFG1EWSSYKTTPPVLDSDGSFFLVSK LTVSKEEWQQGFVFSCSVMHEALHNHYTQKSLSLSPGK | Clone CH3C.35.20.1.1 with hole, LALA, and YTE mutations |
| 501 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFG1EWSSYKTTPPVLDSDGSFFLVSK LTVSKEEWQQGFVFSCSVMHEALHNHYTQKSLSLSPGK | Clone CH3C.35.20.1.1 with hole, LALAPG, and YIEmutations |
| 502 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWANYKTTPPVLDSDGSFFLYSKL TVSKSEWQQGFVFSCSVMHEALHNHYTQKSLSLSPGK | Clone CH3C.35.23.2.1 with knob mutation |
| 503 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVMHEALHNHYTQKSLSLSPGK | Clone CH3C.35.23.2.1 with knob and LALA mutations |
| 504 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVMHEALHNHYTQKSLSLSPGK | Clone CH3C.35.23.2.1 with knob and LALAPG mutations |
| 505 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWANYKTTPPVLDSDGSFFLYSKL TVSKSEWQQGFVFSCSVMHEALHNHYTQKSLSLSPGK | Clone CH3C.35.23.2.1 with knob and YTE mutations |
| 506 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVMHEALHNHYTQKSLSLSPGK | Clone CH3C.35.23.2.1 with knob, LALA, and YTE mutations |
| 507 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVMHEALHNHYTQKSLSLSPGK | Clone CH3C.35.23.2.1 with knob, LALAPG, and YTE mutations |
| 508 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWANYKTTPPVLDSDGSFFLVSKLT VSKSEWQQGFVFSCSVMHEALHNHYTQKSLSLSPGK | Clone CH3C.35.23.2.1 with hole mutations |
| 509 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVMHEALHNHYTQKSLSLSPGK | Clone CH3C.35.23.2.1 with hole and LALA mutations |
| 510 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVMHEALHNHYTQKSLSLSPGK | Clone CH3C.35.23.2.1 with hole and LALAPG mutations |
| 511 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWANYKTTPPVLDSDGSFFLVSKLT VSKSEWQQGFVFSCSVMHEALHNHYTQKSLSLSPGK | Clone CH3C.35.23.2.1 with hole and YTE mutations |
| 512 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVMHEALHNHYTQKSLSLSPGK | Clone CH3C.35.23.2.1 with hole, LALA, and YTE mutations |

US 11,773,185 B2

TABLE 12-continued

Informal Sequence Listing

| SEQ ID NO: | Sequence | Description |
|---|---|---|
| 513 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVMHEALHNHYTQKSLSLSPGK | Clone CH3C.35.23.2.1 with hole, LALAPG, and YTE mutations |
| 514 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSNYKTTPPVLDSDGSFFLYSKLT VSKEEWQQGFVFSCSVMHEALHNHYTQKSLSLSPGK | Clone CH3C.35.23.1.1 with knob mutation |
| 515 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVMHEALHNHYTQKSLSLSPGK | Clone CH3C.35.23.1.1 with knob and LALA mutations |
| 516 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVMHEALHNHYTQKSLSLSPGK | Clone CH3C.35.23.1.1 with knob and LALAPG mutations |
| 517 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSNYKTTPPVLDSDGSFFLYSKLT VSKEEWQQGFVFSCSVMHEALHNHYTQKSLSLSPGK | Clone CH3C.35.23.1.1 with knob and YTE mutations |
| 518 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVMHEALHNHYTQKSLSLSPGK | Clone CH3C.35.23.1.1 with knob, LALA, and YTE mutations |
| 519 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVMHEALHNHYTQKSLSLSPGK | Clone CH3C.35.23.1.1 with knob, LALAPG, and YTE mutations |
| 520 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFG1EWSNYKTTPPVLDSDGSFFLVSKLT VSKEEWQQGFVFSCSVMHEALHNHYTQKSLSLSPGK | Clone CH3C.35.23.1.1 with hole mutations |
| 521 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFG1EWSNYKTTPPVLDSDGSFFLVSK LTVSKEEWQQGFVFSCSVMHEALHNHYTQKSLSLSPGK | Clone CH3C.35.23.1.1 with hole and LALA mutations |
| 522 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFG1EWSNYKTTPPVLDSDGSFFLVSK LTVSKEEWQQGFVFSCSVMHEALHNHYTQKSLSLSPGK | Clone CH3C.35.23.1.1 with hole and LALAPG mutations |
| 523 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFG1EWSNYKTTPPVLDSDGSFFLVSKLT VSKEEWQQGFVFSCSVMHEALHNHYTQKSLSLSPGK | Clone CH3C.35.23.1.1 with hole and YTE mutations |
| 524 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFG1EWSNYKTTPPVLDSDGSFFLVSK LTVSKEEWQQGFVFSCSVMHEALHNHYTQKSLSLSPGK | Clone CH3C.35.23.1.1 with hole, LALA, and YTE mutations |
| 525 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFG1EWSNYKTTPPVLDSDGSFFLVSK LTVSKEEWQQGFVFSCSVMHEALHNHYTQKSLSLSPGK | Clone CH3C.35.23.1.1 with hole, LALAPG, and YTE mutations |

TABLE 12-continued

Informal Sequence Listing

| SEQ ID NO: | Sequence | Description |
|---|---|---|
| 526 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESFGTEWSSYKTTPPVLDSDGSFFLYSKLT<br>VTKEEWQQGFVFSCSVLHEALHSHYTQKSLSLSPGK | Clone CH3C.35.20.1 M201L and N207S mutations |
| 527 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLWCLVKGFYPSDIAVEWESFGTEWSSYKTTPPVLDSDGSFFLYSKLT<br>VTKEEWQQGFVFSCSVLHEALHSHYTQKSLSLSPGK | Clone CH3C.35.20.1 with knob and M201L and N207S mutations |
| 528 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLWCLVKGFYPSDIAVEWESFGTEWSSYKTTPPVLDSDGSFFLYSK<br>LTVTKEEWQQGFVFSCSVLHEALHSHYTQKSLSLSPGK | Clone CH3C.35.20.1 with knob, LALA, and M201L and N207S mutations |
| 529 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLWCLVKGFYPSDIAVEWESFGTEWSSYKTTPPVLDSDGSFFLYSK<br>LTVTKEEWQQGFVFSCSVLHEALHSHYTQKSLSLSPGK | Clone CH3C.35.20.1 with knob, LALAPG, and M201L and N207S mutations |
| 530 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLSCAVKGFYPSDIAVEWESFGTEWSSYKTTPPVLDSDGSFFLVSKLT<br>VTKEEWQQGFVFSCSVLHEALHSHYTQKSLSLSPGK | Clone CH3C.35.20.1 with hole and M201L and N207S mutations |
| 531 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLSCAVKGFYPSDIAVEWESFGTEWSSYKTTPPVLDSDGSFFLVSK<br>LTVTKEEWQQGFVFSCSVLHEALHSHYTQKSLSLSPGK | Clone CH3C.35.20.1 with hole, LALA, and M201L and N207S mutations |
| 532 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLSCAVKGFYPSDIAVEWESFGTEWSSYKTTPPVLDSDGSFFLVSK<br>LTVTKEEWQQGFVFSCSVLHEALHSHYTQKSLSLSPGK | Clone CH3C.35.20.1 with hole, LALAPG, and M201L and N207S mutations |
| 533 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLTCLVKGFYPSDIAVEWESYGTEWANYKTTPPVLDSDGSFFLYSKLT<br>VTKEEWQQGFVFSCSVLHEALHSHYTQKSLSLSPGK | Clone CH3C.35.23.2 with M201L and N207S mutations |
| 534 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLWCLVKGFYPSDIAVEWESYGTEWANYKTTPPVLDSDGSFFLYSKL<br>TVTKEEWQQGFVFSCSVLHEALHSHYTQKSLSLSPGK | Clone CH3C.35.23.2 with knob and M201L and N207S mutations |
| 535 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALPAPIEKTISKAKGQPREPQV<br>YTLPPSRDELTKNQVSLWCLVKGFYPSDIAVEWESYGTEWANYKTTPPVLDSDGSFFLYS<br>KLTVTKEEWQQGFVFSCSVLHEALHSHYTQKSLSLSPGK | Clone CH3C.35.23.2 with knob, LALA, and M201L and N207S mutations |
| 536 | APEAAGGPSVFLFPPKPKDTLMISRTPEVTCVVVDVSHEDPEVKFNWYVDGVEVHNAKT<br>KPREEQYNSTYRVVSVLTVLHQDWLNGKEYKCKVSNKALGAPIEKTISKAKGQPREPQV<br>YTLPPSRDELTKNQVSLWCLVKGFYPSDIAVEWESYGTEWANYKTTPPVLDSDGSFFLYS<br>KLTVTKEEWQQGFVFSCSVLHEALHSHYTQKSLSLSPGK | Clone CH3C.35.23.2 with knob, LALAPG, and M201L and N207S mutations |
| 537 | APELLGGPSVFLFPPKPKDTLMISRTPEVTCVVVDVSHEDPEVKFNWYVDGVEVHNAKTK<br>PREEQYNSTYRVVSVLTVLHQDWLNGKEYKCKVSNKALPAPIEKTISKAKGQPREPQVYT<br>LPPSRDELTKNQVSLSCAVKGFYPSDIAVEWESYGTEWANYKTTPPVLDSDGSFFLVSKLT<br>VTKEEWQQGFVFSCSVLHEALHSHYTQKSLSLSPGK | Clone CH3C.35.23.2 with hole and M201L and N207S mutations |

TABLE 12-continued

Informal Sequence Listing

| SEQ ID NO: | Sequence | Description |
|---|---|---|
| 538 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWANYKTTPPVLDSDGSFFLVS KLTVTKEEWQQGFVFSCSVLHEALHSHYTQKSLSLSPGK | Clone CH3C.35.23.2 with hole, LALA, and M201L and N207S mutations |
| 539 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWANYKTTPPVLDSDGSFFLVS KLTVTKEEWQQGFVFSCSVLHEALHSHYTQKSLSLSPGK | Clone CH3C.35.23.2 with hole, LALAPG, and M201L and N207S mutations |
| 540 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWVNYKTTPPVLDSDGSFFLYSKLT VTKEEWQQGFVFSCSVLHEALHSHYTQKSLSLSPGK | Clone CH3C.35.23.3 with M201L and N207S mutations |
| 541 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWVNYKTTPPVLDSDGSFFLYSKL TVTKEEWQQGFVFSCSVLHEALHSHYTQKSLSLSPGK | Clone CH3C.35.23.3 with knob and M201L and N207S mutations |
| 542 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWVNYKTTPPVLDSDGSFFLYS KLTVTKEEWQQGFVFSCSVLHEALHSHYTQKSLSLSPGK | Clone CH3C.35.23.3 with knob, LALA, and M201L and N207S mutations |
| 543 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWVNYKTTPPVLDSDGSFFLYS KLTVTKEEWQQGFVFSCSVLHEALHSHYTQKSLSLSPGK | Clone CH3C.35.23.3 with knob, LALAPG, and M201L and N207S mutations |
| 544 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWVNYKTTPPVLDSDGSFFLVSKLT VTKEEWQQGFVFSCSVLHEALHSHYTQKSLSLSPGK | Clone CH3C.35.23.3 with hole and M201L and N207S mutations |
| 545 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVLHEALHSHYTQKSLSLSPGK | Clone CH3C.35.23.3 with hole, LALA, and M201L and N207S mutations |
| 546 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWVNYKTTPPVLDSDGSFFLVS KLTVTKEEWQQGFVFSCSVLHEALHSHYTQKSLSLSPGK | Clone CH3C.35.23.3 with hole, LALAPG, and M201L and N207S mutations |
| 547 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSNYKTTPPVLDSDGSFFLYSKLT VSKEEWQQGFVFSCSVLHEALHSHYTQKSLSLSPGK | Clone CH3C.35.23.4 with M201L and N207S mutations |
| 548 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVSKEEWQQGFVFSCSVLHEALHSHYTQKSLSLSPGK | Clone CH3C.35.23.4 with knob and M201L and N207S mutations |
| 549 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVLHEALHSHYTQKSLSLSPGK | Clone CH3C.35.23.4 with knob, LALA, and M201L and N207S mutations |

TABLE 12-continued

Informal Sequence Listing

| SEQ ID NO: | Sequence | Description |
|---|---|---|
| 550 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVSKEEWQQGFVFSCSVLHEALHSHYTQKSLSLSPGK | Clone CH3C.35.23.4 with knob, LALAPG, and M201L and N207S mutations |
| 551 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VSKEEWQQGFVFSCSVLHEALHSHYTQKSLSLSPGK | Clone CH3C.35.23.4 with hole and M201L and N207S mutations |
| 552 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVLHEALHSHYTQKSLSLSPGK | Clone CH3C.35.23.4 with hole, LALA, and M201L and N207S mutations |
| 553 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVSKEEWQQGFVFSCSVLHEALHSHYTQKSLSLSPGK | Clone CH3C.35.23.4 with hole, LALAPG, and M201L and N207S mutations |
| 554 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVLWESYGTEWASYKTTPPVLDSDGSFFLYSKLT VTKEEWQQGFVFSCSVLHEALHSHYTQKSLSLSPGK | Clone CH3C.35.21.17.2 with M201L and N207S mutations |
| 555 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVLWESYGTEWASYKTTPPVLDSDGSFFLYSKL TVTKEEWQQGFVFSCSVLHEALHSHYTQKSLSLSPGK | Clone CH3C.35.21.17.2 with knob and M201L and N207S mutations |
| 556 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVLHEALHSHYTQKSLSLSPGK | Clone CH3C.35.21.17.2 with knob, LALA, and M201L and N207S mutations |
| 557 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVLWESYGTEWASYKTTPPVLDSDGSFFLYS KLTVTKEEWQQGFVFSCSVLHEALHSHYTQKSLSLSPGK | Clone CH3C.35.21.17.2 with knob, LALAPG, and M201L and N207S mutations |
| 558 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVLWESYGTEWASYKTTPPVLDSDGSFFLVSKLT VTKEEWQQGFVFSCSVLHEALHSHYTQKSLSLSPGK | Clone CH3C.35.21.17.2 with hole and M201L and N207S mutations |
| 559 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVLHEALHSHYTQKSLSLSPGK | Clone CH3C.35.21.17.2 with hole, LALA, and M201L and N207S mutations |
| 560 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVLWESYGTEWASYKTTPPVLDSDGSFFLVSK LTVTKEEWQQGFVFSCSVLHEALHSHYTQKSLSLSPGK | Clone CH3C.35.21.17.2 with hole, LALAPG, and M201L and N207S mutations |
| 561 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWSNYKTTPPVLDSDGSFFLYSKLT VTKEEWQQGFVFSCSVLHEALHSHYTQKSLSLSPGK | Clone CH3C.35.23 with M201L and N207S mutations |

TABLE 12-continued

Informal Sequence Listing

| SEQ ID NO: | Sequence | Description |
|---|---|---|
| 562 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWSNYKTTPPVLDSDGSFFLYSKL TVTKEEWQQGFVFSCSVLHEALHSHYTQKSLSLSPGK | Clone CH3C.35.23 with knob and M201L and N207S mutations |
| 563 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVLHEALHSHYTQKSLSLSPGK | Clone CH3C.35.23 with knob, LALA, and M201L and N207S mutations |
| 564 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWSNYKTTPPVLDSDGSFFLYS KLTVTKEEWQQGFVFSCSVLHEALHSHYTQKSLSLSPGK | Clone CH3C.35.23 with knob, LALAPG, and M201L and N207S mutations |
| 565 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWSNYKTTPPVLDSDGSFFLVSKLT VTKEEWQQGFVFSCSVLHEALHSHYTQKSLSLSPGK | Clone CH3C.35.23 with hole and M201L and N207S mutations |
| 566 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVLHEALHSHYTQKSLSLSPGK | Clone CH3C.35.23 with hole, LALA, and M201L and N207S mutations |
| 567 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWSNYKTTPPVLDSDGSFFLVSK LTVTKEEWQQGFVFSCSVLHEALHSHYTQKSLSLSPGK | Clone CH3C.35.23 with hole, LALAPG, and M201L and N207S mutations |
| 568 | PCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLTCLVKGFYPSDIAVWWESYGTEWSSYKTTPPVLDSDGSFFLY SKLTVTKEEWQQGFVFSCSVLHEALHSHYTQKSLSLSPGK | Clone CH3C.35.21 with M201L and N207S mutations |
| 569 | PCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVLHEALHSHYTQKSLSLSPGK | Clone CH3C.35.21 with knob and M201L and N207S mutations |
| 570 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLWCLVKGFYPSDIAVWWESYGTEWSSYKTTPPVLDSDGSFFLY SKLTVTKEEWQQGFVFSCSVLHEALHSHYTQKSLSLSPGK | Clone CH3C.35.21 with knob, LALA, and M201L and N207S mutations |
| 571 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLWCLVKGFYPSDIAVWWESYGTEWSSYKTTPPVLDSDGSFFL YSKLTVTKEEWQQGFVFSCSVLHEALHSHYTQKSLSLSPGK | Clone CH3C.35.21 with knob, LALAPG, and M201L and N207S mutations |
| 572 | PCPAPELLGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVLHEALHSHYTQKSLSLSPGK | Clone CH3C.35.21 with hole and M201L and N207S mutations |
| 573 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALPAPIEKTISKAKGQPREPQ VYTLPPSRDELTKNQVSLSCAVKGFYPSDIAVWWESYGTEWSSYKTTPPVLDSDGSFFLV SKLTVTKEEWQQGFVFSCSVLHEALHSHYTQKSLSLSPGK | Clone CH3C.35.21 with hole, LALA, and M201L and N207S mutations |

TABLE 12-continued

Informal Sequence Listing

| SEQ ID NO: | Sequence | Description |
|---|---|---|
| 574 | PCPAPEAAGGPSVFLFPPKPKDTLMISRTPEVTCVVVDVSHEDPEVKFNWYVDGVEVHNA KTKPREEQYNSTYRVVSVLTVLHQDWLNGKEYKCKVSNKALGAPIEKTISKAKGQPREP QVYTLPPSRDELTKNQVSLSCAVKGFYPSDIAVVWWESYGTEWSSYKTTPPVLDSDGSFFL VSKLTVTKEEWQQGFVFSCSVLHEALHSHYTQKSLSLSPGK | Clone CH3C.35.21 with hole, LALAPG, and M201L and N207S mutations |
| 575 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWSSYKTTPPVLDSDGSFFLYSKLT VSKEEWQQGFVFSCSVLHEALHSHYTQKSLSLSPGK | Clone CH3C.35.20.1.1 with M201L and N207S mutations |
| 576 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSSYKTTPPVLDSDGSFFLYSKLT VSKEEWQQGFVFSCSVLHEALHSHYTQKSLSLSPGK | Clone CH3C.35.20.1.1 with knob and M201L and N207S mutations |
| 577 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSSYKTTPPVLDSDGSFFLYSK LTVSKEEWQQGFVFSCSVLHEALHSHYTQKSLSLSPGK | Clone CH3C.35.20.1.1 with knob, LALA, and M201L and N207S mutations |
| 578 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSSYKTTPPVLDSDGSFFLYSK LTVSKEEWQQGFVFSCSVLHEALHSHYTQKSLSLSPGK | Clone CH3C.35.20.1.1 with knob, LALAPG, and M201L and N207S mutations |
| 579 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFGTEWSSYKTTPPVLDSDGSFFLVSKLT VSKEEWQQGFVFSCSVLHEALHSHYTQKSLSLSPGK | Clone CH3C.35.20.1.1 with hole and M201L and N207S mutations |
| 580 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFGTEWSSYKTTPPVLDSDGSFFLVSK LTVSKEEWQQGFVFSCSVLHEALHSHYTQKSLSLSPGK | Clone CH3C.35.20.1.1 with hole, LALA, and M201L and N207S mutations |
| 581 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFGTEWSSYKTTPPVLDSDGSFFLVSK LTVSKEEWQQGFVFSCSVLHEALHSHYTQKSLSLSPGK | Clone CH3C.35.20.1.1 with hole, LALAPG, and M201L and N207S mutations |
| 582 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESYGTEWANYKTTPPVLDSDGSFFLYSKLT VSKSEWQQGFVFSCSVLHEALHSHYTQKSLSLSPGK | Clone CH3C.35.23.2.1 with M201L and N207S mutations |
| 583 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESYGTEWANYKTTPPVLDSDGSFFLYSKL TVSKSEWQQGFVFSCSVLHEALHSHYTQKSLSLSPGK | Clone CH3C.35.23.2.1 with knob and M201L and N207S mutations |
| 584 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVLHEALHSHYTQKSLSLSPGK | Clone CH3C.35.23.2.1 with knob, LALA, and M201L and N207S mutations |
| 585 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESYGTEWANYKTTPPVLDSDGSFFLYS KLTVSKSEWQQGFVFSCSVLHEALHSHYTQKSLSLSPGK | Clone CH3C.35.23.2.1 with knob, LALAPG, and M201L and N207S mutations |

TABLE 12-continued

Informal Sequence Listing

| SEQ ID NO: | Sequence | Description |
|---|---|---|
| 586 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESYGTEWANYKTTPPVLDSDGSFFLVSKLT VSKSEWQQGFVFSCSVLHEALHSHYTQKSLSLSPGK | Clone CH3C.35.23.2.1 with hole and M201L and N207S mutations |
| 587 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVLHEALHSHYTQKSLSLSPGK | Clone CH3C.35.23.2.1 with hole, LALA, and M201L and N207S mutations |
| 588 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESYGTEWANYKTTPPVLDSDGSFFLVS KLTVSKSEWQQGFVFSCSVLHEALHSHYTQKSLSLSPGK | Clone CH3C.35.23.2.1 with hole, LALAPG, and M201L and N207S mutations |
| 589 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESFGTEWSNYKTTPPVLDSDGSFFLYSKLT VSKEEWQQGFVFSCSVLHEALHSHYTQKSLSLSPGK | Clone CH3C.35.23.1.1 with M201L and N207S mutations |
| 590 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESFGTEWSNYKTTPPVLDSDGSFFLYSKLT VSKEEWQQGFVFSCSVLHEALHSHYTQKSLSLSPGK | Clone CH3C.35.23.1.1 with knob and M201L and N207S mutations |
| 591 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVLHEALHSHYTQKSLSLSPGK | Clone CH3C.35.23.1.1 with knob, LALA, and M201L and N207S mutations |
| 592 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESFGTEWSNYKTTPPVLDSDGSFFLYS KLTVSKEEWQQGFVFSCSVLHEALHSHYTQKSLSLSPGK | Clone CH3C.35.23.1.1 with knob, LALAPG, and M201L and N207S mutations |
| 593 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESFGTEWSNYKTTPPVLDSDGSFFLVSKLT VSKEEWQQGFVFSCSVLHEALHSHYTQKSLSLSPGK | Clone CH3C.35.23.1.1 with hole and M201L and N207S mutations |
| 594 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESFGTEWSNYKTTPPVLDSDGSFFLVSK LTVSKEEWQQGFVFSCSVLHEALHSHYTQKSLSLSPGK | Clone CH3C.35.23.1.1 wit h hole, LALA, and M201L and N207S mutations |
| 595 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESFGTEWSNYKTTPPVLDSDGSFFLVSK LTVSKEEWQQGFVFSCSVLHEALHSHYTQKSLSLSPGK | Clone CH3C.35.23.1.1 with hole, LALAPG, and M201L and N207S mutations |
| 596 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLTCLVKGFYPSDIAVEWESNGQPENNYKTTPPVLDSDGSFFLYSKLT VDKSRWQQGNVFSCSVLHEALHSHYTQKSLSLSPGK | Fc sequence with M198L and N204S mutations |
| 597 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESNGQPENNYKTTPPVLDSDGSFFLYSKLT VDKSRWQQGNVFSCSVLHEALHSHYTQKSLSLSPGK | Fc sequence with knob and M198L and N204S mutations |

TABLE 12-continued

Informal Sequence Listing

| SEQ ID NO: | Sequence | Description |
|---|---|---|
| 598 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESNGQPENNYKTTPPVLDSDGSFFLYS KLTVDKSRWQQGNVFSCSVLHEALHSHYTQKSLSLSPGK | Fc sequence with knob, LALA, and M198L and N204S mutations |
| 599 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLWCLVKGFYPSDIAVEWESNGQPENNYKTTPPVLDSDGSFFLYS KLTVDKSRWQQGNVFSCSVLHEALHSHYTQKSLSLSPGK | Fc sequence with knob, LALAPG, and M198L and N204S mutations |
| 600 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESNGQPENNYKTTPPVLDSDGSFFLVSKLT VDKSRWQQGNVFSCSVLHEALHSHYTQKSLSLSPGK | Fc sequence with hole and M198L and N204S mutations |
| 601 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESNGQPENNYKTTPPVLDSDGSFFLVSK LTVDKSRWQQGNVFSCSVLHEALHSHYTQKSLSLSPGK | Fc sequence with hole, LALA, and M198L and N204S mutations |
| 602 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALGAPIEKTISKAKGQPREPQV YTLPPSRDELTKNQVSLSCAVKGFYPSDIAVEWESNGQPENNYKTTPPVLDSDGSFFLVSK LTVDKSRWQQGNVFSCSVLHEALHSHYTQKSLSLSPGK | Fc sequence with hole, LALAPG, and M198L and N204S mutations |
| 603 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESNGQPENNYKTTPPVLDSDGSFFLVSKLT VDKSRWQQGNVFSCSVMHEALHNHYTQKSLSLSPGK | Fc sequence with hole mutations |
| 604 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESNGQPENNYKTTPPVLDSDGSFFLVSK LTVDKSRWQQGNVFSCSVMHEALHNHYTQKSLSLSPGK | Fc sequence with hole and LALA mutations |
| 605 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLSCAVKGFYPSDIAVEWESNGQPENNYKTTPPVLDSDGSFFLVSKLT VDKSRWQQGNVFSCSVMHEALHNHYTQKSLSLSPGK | Fc sequence with hole and YTE mutations |
| 606 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLSCAVKGFYPSDIAVEWESNGQPENNYKTTPPVLDSDGSFFLVSK LTVDKSRWQQGNVFSCSVMHEALHNHYTQKSLSLSPGK | Fc sequence with hole, LALA, and YTE mutations |
| 607 | APELLGGPSVFLFPPKPKDTLMISRTPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESNGQPENNYKTTPPVLDSDGSFFLYSKLT VDKSRWQQGNVFSCSVMHEALHNHYTQKSLSLSPGK | Fc sequence with knob mutation |
| 608 | APEAAGGPSVFLFPPKPKDTLMISRTPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESNGQPENNYKTTPPVLDSDGSFFLYS KLTVDKSRWQQGNVFSCSVMHEALHNHYTQKSLSLSPGK | Fc sequence with knob and LALA mutations |
| 609 | APELLGGPSVFLFPPKPKDTLYITREPEVTCVVVDVSHEDPEVKFNWYVDGVEVHNAKTK PREEQYNSTYRVVSVLTVLHQDWLNGKEYKCKVSNKALPAPIEKTISKAKGQPREPQVYT LPPSRDELTKNQVSLWCLVKGFYPSDIAVEWESNGQPENNYKTTPPVLDSDGSFFLYSKLT VDKSRWQQGNVFSCSVMHEALHNHYTQKSLSLSPGK | Fc sequence with knob and YTE mutations |
| 610 | APEAAGGPSVFLFPPKPKDTLYITREPEVTCVVVDVSHEDPEVKFNWYVDGVEVHNAKT KPREEQYNSTYRVVSVLTVLHQDWLNGKEYKCKVSNKALPAPIEKTISKAKGQPREPQV YTLPPSRDELTKNQVSLWCLVKGFYPSDIAVEWESNGQPENNYKTTPPVLDSDGSFFLYS KLTVDKSRWQQGNVFSCSVMHEALHNHYTQKSLSLSPGK | Fc sequence with knob, LALA, and YTE mutations |
| 611 | HHHHHH | 6xHis epitope tag sequence |

SEQUENCE LISTING (611 sequences)

SEQ ID NO: 1 - protein, 112 aa, Artificial Sequence
  source: /note="Description of Artificial Sequence: Synthetic polypeptide"
EVQLQQSGAELVRPGSSVKMSCKTSGYTFTSYGMNWVKQRPGQGLEWIGYIYSANGYTEYNEKFKGKATLTSDTSSSTAYMQLSSLTSEDSAIYFCARGDYWGHGTTLTVSS

SEQ ID NO: 2 - protein, 116 aa, Artificial Sequence
  source: /note="Description of Artificial Sequence: Synthetic polypeptide"
EVQLQQPGTELVRPGTSVKLSCKASGYTFTNFWMHWVKQRPGQGLEWIGVINPSDTYTKFNQKFRGKATLTVDTSSSTAYMQLSSLTSEDSAVYFCARPTVGLDYWGQGTSVTVSS

SEQ ID NO: 3 - protein, 117 aa, Artificial Sequence
  source: /note="Description of Artificial Sequence: Synthetic polypeptide"
EVQLQQSGPELVKPGASVKISCQASDYSFTIYYLHWVKQRPGQGLEWIGWIYPGSDTNKYNEKFKDRATLTADTSSSTAYMQLSSLTSEDSAVYYCARGLDGYFTYWGQGTSVTVSS

SEQ ID NO: 4 - protein, 117 aa, Artificial Sequence
  source: /note="Description of Artificial Sequence: Synthetic polypeptide"
EVQLQQSGAELVKPGASVKLSCTASGFKIKDYYIHWMKQRTEQGLEWIGKIDPADGETTYDPKFQGKATITADTSSNTAYLQLSSLTSEDTAVYYCVRSTLVLFDYWGQGTTLTVSS

SEQ ID NO: 5 - protein, 117 aa, Artificial Sequence
  source: /note="Description of Artificial Sequence: Synthetic polypeptide"
EVKLMESGPGLVAPSQSLSISCTVSGFSLTSYGVDWVRQPPGKGLEWLGVVWGGGSTNYNSALMSRLSISKDNSKSQVFLKMNSLQTDDTAMYYCAKRDYFGGLNVWGTGTTVTVSS

SEQ ID NO: 6 - protein, 118 aa, Artificial Sequence
  source: /note="Description of Artificial Sequence: Synthetic polypeptide"
EVQLQQSGAELVKPGASVKMSCKASGYTFTSYWITWVKQRPGQGLEWIGDIYPGSGSSNNNEKFKRKATLTVDTSSSTAYMQLSSLTSEDSAVYYCARGTGTRTMDYWGQGTSVTVSS

SEQ ID NO: 7 - protein, 118 aa, Artificial Sequence
  source: /note="Description of Artificial Sequence: Synthetic polypeptide"
EIQLQQSGAELVMPGSSVKLSCTASGFSIADYYIHWLKQRTEQGLEWIGKIDPADGETKYAPKFQDKATITADTSSNTAYLQLSRLTSEDTAVYYCARTMVVERFDYWGQGTTVTVSS

SEQ ID NO: 8 - protein, 119 aa, Artificial Sequence
  source: /note="Description of Artificial Sequence: Synthetic polypeptide"
EIQLQQSGPELKKPGETVKISCKTSGYTFTTYGMTWVKQAPGKGLKWMGWINTYSGVPIYADDFKGRSAFSLETSASTAYLQINNLENEDTATYFCARRGSTAHYFDYWGQGTTVTVSS

SEQ ID NO: 9 - protein, 119 aa, Artificial Sequence
  source: /note="Description of Artificial Sequence: Synthetic polypeptide"
EVQLQQSGADLMKPGASVKLSCKATGYTFTGYWIEWVKQRPGHGLEWIGEIFPGSVSTNYNEKFKGKATFTADTSSNTAYMQLSSLTTEDSAIYYCARSPIYYDYADYWGQGTTLTVSS

SEQ ID NO: 10 - protein, 118 aa, Artificial Sequence
  source: /note="Description of Artificial Sequence: Synthetic polypeptide"
EVKLMESGPGLVAPSQSLSITCTVSGFSLTSYPINWVRQPPGKGLEWLGVIWTGGSTNYNSALKSRLSISRDNSKSQVFLKMNSLQTDDTARYYCARWDGYFGAFDYWGQGTTVTVSS

SEQ ID NO: 11 - protein, 119 aa, Artificial Sequence
  source: /note="Description of Artificial Sequence: Synthetic polypeptide"
EVHVKQSGPELKKPGETVTISCKASGYTFTTYGMTWVRQAPGKDLEWMGWINTHSGVPIYADDFKGRFAFSLETSAGTAYLQINNLKNEDTATYFCTRRGRLGHYFDYWGQGTSVTVSS

SEQ ID NO: 12 - protein, 121 aa, Artificial Sequence
  source: /note="Description of Artificial Sequence: Synthetic polypeptide"
EVQLVESGGGLVQPKGSLKLSCAASGFTFNTYAMHWVRQAPGKGLEWVARIRIKSKNYATYYADSVKDRFTISRDDSQSMLYLQMNNLKTEDTAMYYCVRAYYTNYWFAYWGQGTLVTVSA

SEQ ID NO: 13 - protein, 121 aa, Artificial Sequence
  source: /note="Description of Artificial Sequence: Synthetic polypeptide"
EVQLVESGGGLVQPQGSLKLSCAASGFTFNTYDMHWVRQAPGRGLEWVGRIRSKSSNYATYYADSVKDRFTFSRDDSQGMLYLQLNNLKTEDTAMYYCVRGIYSNYVFSYWGQGTLVTVSA

SEQ ID NO: 14 - protein, 121 aa, Artificial Sequence
  source: /note="Description of Artificial Sequence: Synthetic polypeptide"
EVQLVESGGGLVQPRGSLKLSCAASGFTFNTFAMHWVRQAPGKGLEWVARIRIKSRNYATYYVDSVKDRFTISRDDSLNMLYLQMNNLKTEDTAMYYCVRGSYSNYWFPYWGHGTLVTVSS

SEQ ID NO: 15 - protein, 120 aa, Artificial Sequence
  source: /note="Description of Artificial Sequence: Synthetic polypeptide"
EVQLQQSGAELMKPGASVKLSCKATGYTFIGYWIDWVKQRPGHGLEWIGEILPGGGSTNHNEKFKGKATFTTDTSSNTVYMQLSSLTTEDSAIYYCAREGSYGNYYFDYWGQGTSVTVSS

SEQ ID NO: 16 - protein, 120 aa, Artificial Sequence
  source: /note="Description of Artificial Sequence: Synthetic polypeptide"
EVQLQQSGAELVKPGASVKMSCKASGYTFTSYWITWVKQRPGQGLEWIGDIYPGSGNTNYNEKFKSKATLTVDTSSSTAHMQLSSLTSEDSAVYYCARFDFGSNYAMDYWGQGTSVTVSS

SEQ ID NO: 17 - protein, 120 aa, Artificial Sequence
  source: /note="Description of Artificial Sequence: Synthetic polypeptide"
EVQLQQPGAELVKPGASVKMSCKASGYTFTSHWITWVKQRPGQGLEWIGDIYPGGGSTNYNEKFKSKATLTADTSSSTAFLQLSSLTSEDSAVYYCARWEGYDGGYFDVWGTGTSVTVSS

SEQ ID NO: 18 - protein, 121 aa, Artificial Sequence
  source: /note="Description of Artificial Sequence: Synthetic polypeptide"
EVQLKDSGPELVKPGASVKLSCKASGYTFTIHGISWVKKRNGQGLEWIGEIYPRTGNTYYNEKFKGKATLTADKSSSTAFMELHSLTSEDSAVYFCARGCYHSSPYYFDYWGQGTTVTVSS

SEQ ID NO: 19 - protein, 121 aa, Artificial Sequence
  source: /note="Description of Artificial Sequence: Synthetic polypeptide"
EVKLVESGGGLVKPGGSLKLSCAASGFTFSDYGMHWVRQAPEKGLEWVAYISSGSSTIYYADTVKGRFTISRDNAKNTLFLQMTSLRSEDTAMYYCARGGSYGYLYYFDYWGQGTTLTVSS

SEQ ID NO: 20 - protein, 122 aa, Artificial Sequence
  source: /note="Description of Artificial Sequence: Synthetic polypeptide"
EVELMESGGGLVKPGGSLKLSCAASGFTFSDYGMHWVRQAPEKGLEWVAYISGGSNFIYYTDTVRGRFTISRDNAKNTLFLQMTSLRSEDTAMYYCARRAYYGSSYWYFDVWGTGTSVTVSS

SEQ ID NO: 21 - protein, 122 aa, Artificial Sequence
  source: /note="Description of Artificial Sequence: Synthetic polypeptide"
EVQLVESGGGLVKPGGSLKLSCAASGFTFSDYGVHWVRQAPEKGLEWVAYISGGSNFIYYTDTVKGRFTISRDNAKNTLSLQMTSLRSEDTAMYYCARRGYYGSSHWYFDVWGTGTSVTVSS

SEQ ID NO: 22 - protein, 122 aa, Artificial Sequence
  source: /note="Description of Artificial Sequence: Synthetic polypeptide"
EVQLVESGGGLVKPGGSLKLSCAASGFTFSDYGMHWVRQAPEKGLEWVAYISGGSNFIYYTDTVKGRFTISRDNAKNTLFLQMTSLRSEDTAMYYCARRGYYGSSHWYFDVWGTGTSVTVSS

SEQ ID NO: 23 - protein, 116 aa, Artificial Sequence
  source: /note="Description of Artificial Sequence: Synthetic polypeptide"
EVQLQQSGPELVKPGASVKLSCKASGYTFTNFWIHWLKQRPGQGLEWIGMIDPSDSYTKYNQKFKAKATLTVDTSSSTTYMHLSSLTSEDSAVYYCARSGVAFPYWGQRTLVTVSA

SEQ ID NO: 24 - protein, 116 aa, Artificial Sequence
  source: /note="Description of Artificial Sequence: Synthetic polypeptide"
EVQLQQPGTELVRPGTSVKLSCKASGYTFTNYWMHWIKQRPGQGLEWIGMIDPSDTYTKFNQNFKGKATLTVDTSSSTAYMQLNSLTSEDSAVYYCARSGVAFPYWGQGTTVTVSS

SEQ ID NO: 25 - protein, 116 aa, Artificial Sequence
  source: /note="Description of Artificial Sequence: Synthetic polypeptide"
EVQLQQSGAELVRPGTSVKLSCKASGYTFTSYWIHWVKQRPGQGLEWIGMIDPSDSYTKYNQKFKDKATLTVDTSSSTTYMHLSSLTSEDSAVYYCARSGVAFPYWGQRTLVTVSA

SEQ ID NO: 26 - protein, 116 aa, Artificial Sequence
  source: /note="Description of Artificial Sequence: Synthetic polypeptide"
EIQLQQSGTELVRPGTSVKLSCKASGYTFTNYWMHWVKQRPGQGLEWIGMIDPSAAYTNYNQNFKGKATLTVDTSSGTAYMQLSSLTSEDSAVYYCARSGVAFPYWGQGTTVTVSS

SEQ ID NO: 27 - protein, 116 aa, Artificial Sequence
  source: /note="Description of Artificial Sequence: Synthetic polypeptide"
EVQLQQPGAEVVRPGTSVKLSCKASGYTFTNYWMHWVKQRPGQGLEWIGMIDPSDNYTKYNQKLKGKATLTVDTSSSTANMHVNSLTSEDSAVYFCARSGVAFPYWGQGTLVTVSA

SEQ ID NO: 28 - protein, 116 aa, Artificial Sequence
  source: /note="Description of Artificial Sequence: Synthetic polypeptide"
EVQLQQSGAELVRPGTSVKLSCKASGYTFNNYWMHWVKQRPGQGLEWIGMIDPSDDDIKNNQKFKGKATLTVDTSSSTAYMQLISLTSEDSAVYYCARSGVALPYWGQGTLVTVSA

SEQ ID NO: 29 - protein, 10 aa, Artificial Sequence
  source: /note="Description of Artificial Sequence: Synthetic peptide"
GYTFTSYGMN

SEQ ID NO: 30 - protein, 10 aa, Artificial Sequence
  source: /note="Description of Artificial Sequence: Synthetic peptide"
GYTFTNFWMH

SEQ ID NO: 31 - protein, 10 aa, Artificial Sequence
  source: /note="Description of Artificial Sequence: Synthetic peptide"
DYSFTIYYLH

SEQ ID NO: 32 - protein, 10 aa, Artificial Sequence
  source: /note="Description of Artificial Sequence: Synthetic peptide"
GFKIKDYYIH

SEQ ID NO: 33 - protein, 10 aa, Artificial Sequence
  source: /note="Description of Artificial Sequence: Synthetic peptide"
GFSLTSYGVD

SEQ ID NO: 34 - protein, 10 aa, Artificial Sequence
  source: /note="Description of Artificial Sequence: Synthetic peptide"
GYTFTSYWIT

SEQ ID NO: 35 - protein, 10 aa, Artificial Sequence
  source: /note="Description of Artificial Sequence: Synthetic peptide"
GFSIADYYIH

SEQ ID NO: 36 - protein, 10 aa, Artificial Sequence
  source: /note="Description of Artificial Sequence: Synthetic peptide"
GYTFTTYGMT

SEQ ID NO: 37 - protein, 10 aa, Artificial Sequence
  source: /note="Description of Artificial Sequence: Synthetic peptide"
GYTFTGYWIE

SEQ ID NO: 38 - protein, 10 aa, Artificial Sequence
  source: /note="Description of Artificial Sequence: Synthetic peptide"
GFSLTSYPIN

SEQ ID NO: 39 - protein, 10 aa, Artificial Sequence
  source: /note="Description of Artificial Sequence: Synthetic peptide"
GFTFNTYAMH

SEQ ID NO: 40 - protein, 10 aa, Artificial Sequence
  source: /note="Description of Artificial Sequence: Synthetic peptide"
GFTFNTYDMH

SEQ ID NO: 41 - protein, 10 aa, Artificial Sequence
  source: /note="Description of Artificial Sequence: Synthetic peptide"
GFTFNTFAMH

SEQ ID NO: 42 - protein, 10 aa, Artificial Sequence
  source: /note="Description of Artificial Sequence: Synthetic peptide"
GYTFIGYWID

SEQ ID NO: 43 - protein, 10 aa, Artificial Sequence
  source: /note="Description of Artificial Sequence: Synthetic peptide"
GYTFTSHWIT

SEQ ID NO: 44 - protein, 10 aa, Artificial Sequence
  source: /note="Description of Artificial Sequence: Synthetic peptide"
GYTFTIHGIS

SEQ ID NO: 45 - protein, 10 aa, Artificial Sequence
  source: /note="Description of Artificial Sequence: Synthetic peptide"
GFTFSDYGMH

SEQ ID NO: 46 - protein, 10 aa, Artificial Sequence
  source: /note="Description of Artificial Sequence: Synthetic peptide"
GFTFSDYGVH

SEQ ID NO: 47 - protein, 10 aa, Artificial Sequence
  source: /note="Description of Artificial Sequence: Synthetic peptide"
GYTFTNFWIH

SEQ ID NO: 48 - protein, 10 aa, Artificial Sequence
  source: /note="Description of Artificial Sequence: Synthetic peptide"
GYTFTNYWMH

SEQ ID NO: 49 - protein, 10 aa, Artificial Sequence
  source: /note="Description of Artificial Sequence: Synthetic peptide"
GYTFTSYWIH

SEQ ID NO: 50 - protein, 10 aa, Artificial Sequence
  source: /note="Description of Artificial Sequence: Synthetic peptide"
GYTFNNYWMH

SEQ ID NO: 51 - protein, 17 aa, Artificial Sequence
  source: /note="Description of Artificial Sequence: Synthetic peptide"
YIYSANGYTEYNEKFKG

SEQ ID NO: 52 - protein, 17 aa, Artificial Sequence
  source: /note="Description of Artificial Sequence: Synthetic peptide"
VINPSDTYTKFNQKFRG

SEQ ID NO: 53 - protein, 17 aa, Artificial Sequence
  source: /note="Description of Artificial Sequence: Synthetic peptide"
WIYPGSDTNKYNEKFKD

SEQ ID NO: 54 - protein, 17 aa, Artificial Sequence
  source: /note="Description of Artificial Sequence: Synthetic peptide"
KIDPADGETTYDPKFQG

SEQ ID NO: 55 - protein, 16 aa, Artificial Sequence
  source: /note="Description of Artificial Sequence: Synthetic peptide"
VVWGGGSTNYNSALMS

SEQ ID NO: 56 - protein, 17 aa, Artificial Sequence
  source: /note="Description of Artificial Sequence: Synthetic peptide"
DIYPGSGSSNNNEKFKR

SEQ ID NO: 57 - protein, 17 aa, Artificial Sequence
  source: /note="Description of Artificial Sequence: Synthetic peptide"
KIDPADGETKYAPKFQD

SEQ ID NO: 58 - protein, 17 aa, Artificial Sequence
  source: /note="Description of Artificial Sequence: Synthetic peptide"
WINTYSGVPIYADDFKG

SEQ ID NO: 59 - protein, 17 aa, Artificial Sequence
  source: /note="Description of Artificial Sequence: Synthetic peptide"
EIFPGSVSTNYNEKFKG

SEQ ID NO: 60 - protein, 16 aa, Artificial Sequence
  source: /note="Description of Artificial Sequence: Synthetic peptide"
VIWTGGSTNYNSALKS

SEQ ID NO: 61 - protein, 17 aa, Artificial Sequence
  source: /note="Description of Artificial Sequence: Synthetic peptide"
WINTHSGVPIYADDFKG

SEQ ID NO: 62 - protein, 19 aa, Artificial Sequence
  source: /note="Description of Artificial Sequence: Synthetic peptide"
RIRIKSKNYATYYADSVKD

SEQ ID NO: 63 - protein, 19 aa, Artificial Sequence
  source: /note="Description of Artificial Sequence: Synthetic peptide"
RIRSKSSNYATYYADSVKD

SEQ ID NO: 64 - protein, 19 aa, Artificial Sequence
  source: /note="Description of Artificial Sequence: Synthetic peptide"
RIRIKSRNYATYYVDSVKD

SEQ ID NO: 65 - protein, 17 aa, Artificial Sequence
  source: /note="Description of Artificial Sequence: Synthetic peptide"
EILPGGGSTNHNEKFKG

SEQ ID NO: 66 - protein, 17 aa, Artificial Sequence
  source: /note="Description of Artificial Sequence: Synthetic peptide"
DIYPGSGNTNYNEKFKS

SEQ ID NO: 67 - protein, 17 aa, Artificial Sequence
  source: /note="Description of Artificial Sequence: Synthetic peptide"
DIYPGGGSTNYNEKFKS

SEQ ID NO: 68 - protein, 17 aa, Artificial Sequence
  source: /note="Description of Artificial Sequence: Synthetic peptide"
EIYPRTGNTYYNEKFKG

SEQ ID NO: 69 - protein, 17 aa, Artificial Sequence
  source: /note="Description of Artificial Sequence: Synthetic peptide"
YISSGSSTIYYADTVKG

SEQ ID NO: 70 - protein, 17 aa, Artificial Sequence
  source: /note="Description of Artificial Sequence: Synthetic peptide"
YISGGSNFIYYTDTVRG

SEQ ID NO: 71 - protein, 17 aa, Artificial Sequence
  source: /note="Description of Artificial Sequence: Synthetic peptide"
YISGGSNFIYYTDTVKG

SEQ ID NO: 72 - protein, 17 aa, Artificial Sequence
  source: /note="Description of Artificial Sequence: Synthetic peptide"
MIDPSDSYTKYNQKFKA

SEQ ID NO: 73 - protein, 17 aa, Artificial Sequence
  source: /note="Description of Artificial Sequence: Synthetic peptide"
MIDPSDTYTKFNQNFKG

SEQ ID NO: 74 - protein, 17 aa, Artificial Sequence
  source: /note="Description of Artificial Sequence: Synthetic peptide"
MIDPSDSYTKYNQKFKD

SEQ ID NO: 75 - protein, 17 aa, Artificial Sequence
  source: /note="Description of Artificial Sequence: Synthetic peptide"
MIDPSAAYTNYNQNFKG

SEQ ID NO: 76 - protein, 17 aa, Artificial Sequence
  source: /note="Description of Artificial Sequence: Synthetic peptide"
MIDPSDNYTKYNQKLKG

SEQ ID NO: 77 - protein, 17 aa, Artificial Sequence
  source: /note="Description of Artificial Sequence: Synthetic peptide"
MIDPSDDDIKNNQKFKG

SEQ ID NO: 78 - protein, 5 aa, Artificial Sequence
  source: /note="Description of Artificial Sequence: Synthetic peptide"
ARGDY

SEQ ID NO: 79 - protein, 9 aa, Artificial Sequence
  source: /note="Description of Artificial Sequence: Synthetic peptide"
ARPTVGLDY

SEQ ID NO: 80 - protein, 10 aa, Artificial Sequence
  source: /note="Description of Artificial Sequence: Synthetic peptide"
ARGLDGYFTY

SEQ ID NO: 81 - protein, 10 aa, Artificial Sequence
  source: /note="Description of Artificial Sequence: Synthetic peptide"
VRSTLVLFDY

SEQ ID NO: 82 - protein, 11 aa, Artificial Sequence
  source: /note="Description of Artificial Sequence: Synthetic peptide"
AKRDYFGGLNV

SEQ ID NO: 83 - protein, 11 aa, Artificial Sequence
  source: /note="Description of Artificial Sequence: Synthetic peptide"
ARGTGTRTMDY

SEQ ID NO: 84 - protein, 11 aa, Artificial Sequence
  source: /note="Description of Artificial Sequence: Synthetic peptide"
ARTMVVERFDY

SEQ ID NO: 85 - protein, 12 aa, Artificial Sequence
  source: /note="Description of Artificial Sequence: Synthetic peptide"
ARRGSTAHYFDY

SEQ ID NO: 86 - protein, 12 aa, Artificial Sequence
  source: /note="Description of Artificial Sequence: Synthetic peptide"
ARSPIYYDYADY

SEQ ID NO: 87 - protein, 12 aa, Artificial Sequence
  source: /note="Description of Artificial Sequence: Synthetic peptide"
ARWDGYFGAFDY

SEQ ID NO: 88 - protein, 12 aa, Artificial Sequence
  source: /note="Description of Artificial Sequence: Synthetic peptide"
TRRGRLGHYFDY

SEQ ID NO: 89 - protein, 12 aa, Artificial Sequence
  source: /note="Description of Artificial Sequence: Synthetic peptide"
VRAYYTNYWFAY

SEQ ID NO: 90 - protein, 12 aa, Artificial Sequence
  source: /note="Description of Artificial Sequence: Synthetic peptide"
VRGIYSNYVFSY

SEQ ID NO: 91 - protein, 12 aa, Artificial Sequence
  source: /note="Description of Artificial Sequence: Synthetic peptide"
VRGSYSNYWFPY

SEQ ID NO: 92 - protein, 13 aa, Artificial Sequence
  source: /note="Description of Artificial Sequence: Synthetic peptide"
AREGSYGNYYFDY

SEQ ID NO: 93 - protein, 13 aa, Artificial Sequence
  source: /note="Description of Artificial Sequence: Synthetic peptide"
ARFDFGSNYAMDY

SEQ ID NO: 94 - protein, 13 aa, Artificial Sequence
  source: /note="Description of Artificial Sequence: Synthetic peptide"
ARWEGYDGGYFDV

SEQ ID NO: 95 - protein, 14 aa, Artificial Sequence
  source: /note="Description of Artificial Sequence: Synthetic peptide"
ARGCYHSSPYYFDY

SEQ ID NO: 96 - protein, 14 aa, Artificial Sequence
  source: /note="Description of Artificial Sequence: Synthetic peptide"
ARGGSYGYLYYFDY

SEQ ID NO: 97 - protein, 15 aa, Artificial Sequence
  source: /note="Description of Artificial Sequence: Synthetic peptide"
ARRAYYGSSYWYFDV

SEQ ID NO: 98 - protein, 15 aa, Artificial Sequence
  source: /note="Description of Artificial Sequence: Synthetic peptide"
ARRGYYGSSHWYFDV

SEQ ID NO: 99 - protein, 9 aa, Artificial Sequence
  source: /note="Description of Artificial Sequence: Synthetic peptide"
ARSGVAFPY

SEQ ID NO: 100 - protein, 9 aa, Artificial Sequence
  source: /note="Description of Artificial Sequence: Synthetic peptide"
ARSGVALPY

SEQ ID NO: 101 - protein, 107 aa, Artificial Sequence
  source: /note="Description of Artificial Sequence: Synthetic polypeptide"
DIQMNQSPSSFSASLGERVSLTCRATQEISGYLIWLQQKPDGTIKRLIYAASTLDSGVPKRFSGNRSGSDYSLTISSLESEDSADYYCLQYASYPWTFGGGTRLEIK

SEQ ID NO: 102 - protein, 107 aa, Artificial Sequence
  source: /note="Description of Artificial Sequence: Synthetic polypeptide"
DIVMTQSQKFMPTSVGDRVSVTCKASQNVGSNVAWYQQKSGQSPKALIYSASHRYSGVPDRFTGSGSGTDFTLTISNVQSEDLAEYFCQQYNSYPYTFGGGTKLEIK

SEQ ID NO: 103 - protein, 107 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIK

SEQ ID NO: 104 - protein, 112 aa, Artificial Sequence
  source: /note="Description of Artificial Sequence: Synthetic polypeptide"
DIQMTQSPLSLPVSLGDQASISCRSSQSLVHSNGYTYLHWFLQKPGQSPKLLISKVSNRFSGVPDRFSSSGSGTDFTLKITRVEAEDLGIYFCSQSTHVPYTFGGGTKLELK

SEQ ID NO: 105 - protein, 107 aa, Artificial Sequence
  source: /note="Description of Artificial Sequence: Synthetic polypeptide"
DIVMTQTTSPLSVSLGDRVTISCRASQDISKYLNWYQQRPDGTVKLLIYYTSRLHSGVPSRFSGSGSGTDYSLTISNLEQEDIATYFCHQGHKIPYTFGGGTKLELK

SEQ ID NO: 106 - protein, 107 aa, Artificial Sequence
  source: /note="Description of Artificial Sequence: Synthetic polypeptide"
DIQMIQSPATLSVTPGDRVSPSCRASQSISDYLHWYQQKSHESPRLLIKYASQSISGIPSRFSGSGSGSDFTLSINSVEPEDVGVFYCQNGHSFPFTFGAGTKLEIK

SEQ ID NO: 107 - protein, 112 aa, Artificial Sequence
  source: /note="Description of Artificial Sequence: Synthetic polypeptide"
DIQMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 108 - protein, 107 aa, Artificial Sequence
  source: /note="Description of Artificial Sequence: Synthetic polypeptide"
DIVLTQSHKFMSTSVGDRVSITCKASQDVSTAVAWYQQKPGQSPKLLIYWASTRHTGVPDRFTGSGSGTDYTLTISSVQAEDLALYYCQQHYSTPYTFGGGTKLELK

SEQ ID NO: 109 - protein, 107 aa, Artificial Sequence
  source: /note="Description of Artificial Sequence: Synthetic polypeptide"
DIVLSQSHKFMSTSVGDRVSITCKASQDVGTAVAWYQQKPGQSPKALIYLASNRHTGVPDRFTGSGSGTDFTLTISNVQSEDLAEYFCQQYNSYPYTFGGGTRLEIK

SEQ ID NO: 110 - protein, 107 aa, Artificial Sequence
  source: /note="Description of Artificial Sequence: Synthetic polypeptide"
DIVMTQTTSSLSASLGDRVTISCRASQDISKYLNWYQQKPDGTVKLLIYYTSRLHSGVPSRFSGSGSGTDYSLTISNLEQEDIATYFCQQSLSLPYTFGGGTRLEIK

SEQ ID NO: 111 - protein, 107 aa, Artificial Sequence
  source: /note="Description of Artificial Sequence: Synthetic polypeptide"
DIVMTQSQKFMSTSVGDRVSVTCKASQNVGTNVAWYQQKPGQSPKLLIYWASTRHTGVPDRFTGSGSGTDFTLTISNVQSEDLADYFCQQYSSYPYTFGGGTKLELK

SEQ ID NO: 112 - protein, 107 aa, Artificial Sequence
  source: /note="Description of Artificial Sequence: Synthetic polypeptide"
DIVLTQSHKFMSTPVGDRVSVTCKASQNVGTNVAWYQQKPGQSPKALIYSASYRYSGVPDRFTGSGSGTDFTLTISNVQSEDLADYFCQQYSSYPLTFGSGTKLELK

SEQ ID NO: 113 - protein, 107 aa, Artificial Sequence
  source: /note="Description of Artificial Sequence: Synthetic polypeptide"
DIQMMQSQKFLSTSIGDGVSVSCKASQNVGTNVAWYQQKPGQSPTALIYSTSYRFSGVPDRFTGSGSGTDFTLTISNVQSEDLAEYFCQQYYSYPLTFGAGTKLEIK

SEQ ID NO: 114 - protein, 107 aa, Artificial Sequence
  source: /note="Description of Artificial Sequence: Synthetic polypeptide"
DIVMTQSHKFMSTSVGDRVSVTCKASQNVGTNVAWYQQKPGQSPKALIYSASYRYSGVPDRFTGSGSGADFTLTISNVQSEDLAEYFCQQYNSYPLTFGAGTKLELK

SEQ ID NO: 115 - protein, 112 aa, Artificial Sequence
  source: /note="Description of Artificial Sequence: Synthetic polypeptide"
DIQMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 116 - protein, 107 aa, Artificial Sequence
  source: /note="Description of Artificial Sequence: Synthetic polypeptide"
DIQMTQSPATLSVTPGDRISLSCRASQSISDYLHWYQQKSHESPRLLIKYASQSISGIPSRFSGSGSGSNFTLSINSVEPEDVGIYYCQNVHRFPLTFGAGTKLELK

SEQ ID NO: 117 - protein, 111 aa, Artificial Sequence
  source: /note="Description of Artificial Sequence: Synthetic polypeptide"
DIVLTQSPASLAVSLGQRATISCRASKSVSTSGYSYMHWYQQKPGQPPKLLIKYASNLESGVPARFSGSGSGTDFTLNIHHVQEEDTATYYCQHSWEIPYTFGGGTKLELK

SEQ ID NO: 118 - protein, 107 aa, Artificial Sequence
  source: /note="Description of Artificial Sequence: Synthetic polypeptide"
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTKLELK

SEQ ID NO: 119 - protein, 106 aa, Artificial Sequence
  source: /note="Description of Artificial Sequence: Synthetic polypeptide"
DIVLTQSPAIMSASPGEKVTMTCSASSSVSYMHWYQQKPGSSPKPWIFATSNLASGVPARFSGSGSGTSYSLTISRVEAEDAATYYCQQWSSKPPTFGAGTKLELK

SEQ ID NO: 120 - protein, 107 aa, Artificial Sequence
  source: /note="Description of Artificial Sequence: Synthetic polypeptide"
DIVMTQSQKFMSTSVGDRVSVTCKASQNVGTNVAWYQQKPGQSPKALIYSASYRYSGVPDRFTGSGSGTDFTLTISNVQSEDLADYFCQQYSSYPLTFGAGTKLEIK

SEQ ID NO: 121 - protein, 107 aa, Artificial Sequence
  source: /note="Description of Artificial Sequence: Synthetic polypeptide"
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPFTFGSGTRLEIK

SEQ ID NO: 122 - protein, 107 aa, Artificial Sequence
  source: /note="Description of Artificial Sequence: Synthetic polypeptide"
DIVMTQSQKFMSKSVGDTVSVTCKASQDVGRNVAWYQQKSGQSPKSLIYSASHRYSGVPDRFTGSGSGTDFTLTISNVQSEDLADYFCQQYNSYPYTFGGGTRLEIK

SEQ ID NO: 123 - protein, 107 aa, Artificial Sequence
  source: /note="Description of Artificial Sequence: Synthetic polypeptide"
DIVMTQSQKFMSTSVGDRVSVTCKASQNVGTNVAWYQQKPGQSPKALIYSASHRYSGVPDRFTGSGSGTDFTLTISNVQSEDLAEYFCQQYNSYMYTFGGGTKLEIK

SEQ ID NO: 124 - protein, 107 aa, Artificial Sequence
  source: /note="Description of Artificial Sequence: Synthetic polypeptide"
DIQMTQSQKFMSTSIGDRVSVTCKASQNVGTNVAWYQQKPGQSPKSLIYSASHWYSGVPDRFTGSGSGTDFTLTISNVQSEDLAEYFCQQYNSYPYTFGGGTKLEIK

SEQ ID NO: 125 - protein, 107 aa, Artificial Sequence
  source: /note="Description of Artificial Sequence: Synthetic polypeptide"
DIVMTQSQKFMSTSVGDRVSITCKASQNVGTNVAWYQQKPGQSPKALIYSASYRYSGVPDRFTGSGSGTDFTLTISNVQSEDLAEYFCQQYNSYPYTFGGGTKLEIK

SEQ ID NO: 126 - protein, 107 aa, Artificial Sequence
  source: /note="Description of Artificial Sequence: Synthetic polypeptide"
DIVMTQSQKFMSTSVGDRVSVTCKASQNVGTNVAWYQQKSGQSPKALIYSASHRYSGVPDRFTGSGSGTDFTLTISNVQSEDLAEYFCQQYNSYPYTFGGGTKLEIK

SEQ ID NO: 127 - protein, 107 aa, Artificial Sequence
  source: /note="Description of Artificial Sequence: Synthetic polypeptide"
DIQMTQSQKFMSKSVGDRVSVTCKASQNVGSNVAWYQQKSGQSPKSLIYSASHRYSGVPDRFTGSGSGTDFTLTISNVQSEDLADYFCQQYNSYPYTFGGGTRLEIK

SEQ ID NO: 128 - protein, 107 aa, Artificial Sequence
  source: /note="Description of Artificial Sequence: Synthetic polypeptide"
DILMTQSQKFMSTSVGDRVSVTCKASQNVGRNVAWYQQISGQSPKPLIYSASHRYSGVPDRFTGSGSGTDFTLTISNVQSEDLVEFFCQQYNSYPYTFGGGTKLEIK

SEQ ID NO: 129 - protein, 11 aa, Artificial Sequence
  source: /note="Description of Artificial Sequence: Synthetic peptide"
RATQEISGYLI

SEQ ID NO: 130 - protein, 11 aa, Artificial Sequence
  source: /note="Description of Artificial Sequence: Synthetic peptide"
KASQNVGSNVA

SEQ ID NO: 131 - protein, 8 aa, Artificial Sequence
  source: /note="Description of Artificial Sequence: Synthetic peptide"
QDISNYLN

SEQ ID NO: 132 - protein, 13 aa, Artificial Sequence
  source: /note="Description of Artificial Sequence: Synthetic peptide"
QSLVHSNGYTYLH

SEQ ID NO: 133 - protein, 8 aa, Artificial Sequence
  source: /note="Description of Artificial Sequence: Synthetic peptide"
QDISKYLN

SEQ ID NO: 134 - protein, 8 aa, Artificial Sequence
  source: /note="Description of Artificial Sequence: Synthetic peptide"
QSISDYLH

SEQ ID NO: 135 - protein, 13 aa, Artificial Sequence
  source: /note="Description of Artificial Sequence: Synthetic peptide"
QSLVHSNGNTYLH

SEQ ID NO: 136 - protein, 11 aa, Artificial Sequence
  source: /note="Description of Artificial Sequence: Synthetic peptide"
KASQDVSTAVA

SEQ ID NO: 137 - protein, 11 aa, Artificial Sequence
  source: /note="Description of Artificial Sequence: Synthetic peptide"
KASQDVGTAVA

SEQ ID NO: 138 - protein, 11 aa, Artificial Sequence
  source: /note="Description of Artificial Sequence: Synthetic peptide"
KASQNVGTNVA

SEQ ID NO: 139 - protein, 13 aa, Artificial Sequence
  source: /note="Description of Artificial Sequence: Synthetic peptide"
QSIVHSNGNTYLE

SEQ ID NO: 140 - protein, 12 aa, Artificial Sequence
  source: /note="Description of Artificial Sequence: Synthetic peptide"
KSVSTSGYSYMH

SEQ ID NO: 141 - protein, 8 aa, Artificial Sequence
  source: /note="Description of Artificial Sequence: Synthetic peptide"
ENIYSNLA

SEQ ID NO: 142 - protein, 10 aa, Artificial Sequence
  source: /note="Description of Artificial Sequence: Synthetic peptide"
SASSSVSYMH

SEQ ID NO: 143 - protein, 11 aa, Artificial Sequence
  source: /note="Description of Artificial Sequence: Synthetic peptide"
KASQDVGRNVA

SEQ ID NO: 144 - protein, 11 aa, Artificial Sequence
  source: /note="Description of Artificial Sequence: Synthetic peptide"
KASQNVGRNVA

SEQ ID NO: 145 - protein, 7 aa, Artificial Sequence
  source: /note="Description of Artificial Sequence: Synthetic peptide"
AASTLDS

SEQ ID NO: 146 - protein, 7 aa, Artificial Sequence
  source: /note="Description of Artificial Sequence: Synthetic peptide"
SASHRYS

SEQ ID NO: 147 - protein, 7 aa, Artificial Sequence
  source: /note="Description of Artificial Sequence: Synthetic peptide"
YTSRLHS

SEQ ID NO: 148 - protein, 7 aa, Artificial Sequence
  source: /note="Description of Artificial Sequence: Synthetic peptide"
KVSNRFS

SEQ ID NO: 149 - protein, 7 aa, Artificial Sequence
  source: /note="Description of Artificial Sequence: Synthetic peptide"
YASQSIS

SEQ ID NO: 150 - protein, 7 aa, Artificial Sequence
  source: /note="Description of Artificial Sequence: Synthetic peptide"
WASTRHT

SEQ ID NO: 151 - protein, 7 aa, Artificial Sequence
  source: /note="Description of Artificial Sequence: Synthetic peptide"
LASNRHT

SEQ ID NO: 152 - protein, 7 aa, Artificial Sequence
  source: /note="Description of Artificial Sequence: Synthetic peptide"
SASYRYS

SEQ ID NO: 153 - protein, 7 aa, Artificial Sequence
  source: /note="Description of Artificial Sequence: Synthetic peptide"
STSYRFS

SEQ ID NO: 154 - protein, 7 aa, Artificial Sequence
  source: /note="Description of Artificial Sequence: Synthetic peptide"
YASNLES

SEQ ID NO: 155 - protein, 7 aa, Artificial Sequence
  source: /note="Description of Artificial Sequence: Synthetic peptide"
AATNLAD

SEQ ID NO: 156 - protein, 7 aa, Artificial Sequence
  source: /note="Description of Artificial Sequence: Synthetic peptide"
ATSNLAS

SEQ ID NO: 157 - protein, 7 aa, Artificial Sequence
  source: /note="Description of Artificial Sequence: Synthetic peptide"
SASHWYS

SEQ ID NO: 158 - protein, 9 aa, Artificial Sequence
  source: /note="Description of Artificial Sequence: Synthetic peptide"
LQYASYPWT

SEQ ID NO: 159 - protein, 9 aa, Artificial Sequence
  source: /note="Description of Artificial Sequence: Synthetic peptide"
QQYNSYPYT

SEQ ID NO: 160 - protein, 7 aa, Artificial Sequence
  source: /note="Description of Artificial Sequence: Synthetic peptide"
QQGNTLP

SEQ ID NO: 161 - protein, 9 aa, Artificial Sequence
  source: /note="Description of Artificial Sequence: Synthetic peptide"
SQSTHVPYT

SEQ ID NO: 162 - protein, 9 aa, Artificial Sequence
  source: /note="Description of Artificial Sequence: Synthetic peptide"
HQGHKIPYT

SEQ ID NO: 163 - protein, 9 aa, Artificial Sequence
  source: /note="Description of Artificial Sequence: Synthetic peptide"
QNGHSFPFT

SEQ ID NO: 164 - protein, 9 aa, Artificial Sequence
  source: /note="Description of Artificial Sequence: Synthetic peptide"
SQSTHVPLT

SEQ ID NO: 165 - protein, 9 aa, Artificial Sequence
  source: /note="Description of Artificial Sequence: Synthetic peptide"
QQHYSTPYT

SEQ ID NO: 166 - protein, 9 aa, Artificial Sequence
  source: /note="Description of Artificial Sequence: Synthetic peptide"
QQSLSLPYT

SEQ ID NO: 167 - protein, 9 aa, Artificial Sequence
  source: /note="Description of Artificial Sequence: Synthetic peptide"
QQYSSYPYT

SEQ ID NO: 168 - protein, 9 aa, Artificial Sequence
  source: /note="Description of Artificial Sequence: Synthetic peptide"
QQYSSYPLT

SEQ ID NO: 169 - protein, 9 aa, Artificial Sequence
  source: /note="Description of Artificial Sequence: Synthetic peptide"
QQYYSYPLT

SEQ ID NO: 170 - protein, 9 aa, Artificial Sequence
  source: /note="Description of Artificial Sequence: Synthetic peptide"
QQYNSYPLT

SEQ ID NO: 171 - protein, 9 aa, Artificial Sequence
  source: /note="Description of Artificial Sequence: Synthetic peptide"
FQGSHVPYT

SEQ ID NO: 172 - protein, 9 aa, Artificial Sequence
  source: /note="Description of Artificial Sequence: Synthetic peptide"
QNVHRFPLT

SEQ ID NO: 173 - protein, 9 aa, Artificial Sequence
  source: /note="Description of Artificial Sequence: Synthetic peptide"
QHSWEIPYT

SEQ ID NO: 174 - protein, 9 aa, Artificial Sequence
  source: /note="Description of Artificial Sequence: Synthetic peptide"
QHFWGTPYT

SEQ ID NO: 175 - protein, 9 aa, Artificial Sequence
  source: /note="Description of Artificial Sequence: Synthetic peptide"
QQWSSKPPT

SEQ ID NO: 176 - protein, 9 aa, Artificial Sequence
  source: /note="Description of Artificial Sequence: Synthetic peptide"
QQYNSYPFT

SEQ ID NO: 177 - protein, 9 aa, Artificial Sequence
  source: /note="Description of Artificial Sequence: Synthetic peptide"
QQYNSYMYT

SEQ ID NO: 178 - protein, 12 aa, Artificial Sequence
  source: /note="Description of Artificial Sequence: Synthetic peptide"
  MOD_RES (1)..(1): Any amino acid
  MOD_RES (3)..(9): Any amino acid
  MOD_RES (11)..(11): Any amino acid
XRXXXXXXXFXY

SEQ ID NO: 179 - protein, 11 aa, Artificial Sequence
  source: /note="Description of Artificial Sequence: Synthetic peptide"
  MOD_RES (5)..(5): Any amino acid
  MOD_RES (7)..(9): Any amino acid
KASQXVXXXVA

SEQ ID NO: 180 - protein, 13 aa, Artificial Sequence
  source: /note="Description of Artificial Sequence: Synthetic peptide"
  MOD_RES (3)..(3): Any amino acid
  MOD_RES (9)..(9): Any amino acid
  MOD_RES (13)..(13): Any amino acid
QSXVHSNGXTYLX

SEQ ID NO: 181 - protein, 8 aa, Artificial Sequence
  source: /note="Description of Artificial Sequence: Synthetic peptide"
  MOD_RES (2)..(2): Any amino acid
  MOD_RES (5)..(5): Any amino acid
  MOD_RES (8)..(8): Any amino acid
QXISXYLX

SEQ ID NO: 182 - protein, 7 aa, Artificial Sequence
  source: /note="Description of Artificial Sequence: Synthetic peptide"
  MOD_RES (1)..(1): Any amino acid
  MOD_RES (4)..(4): Any amino acid
  MOD_RES (6)..(6): Any amino acid
XTSXLXS

SEQ ID NO: 183 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKEEWQQGFVFSCSVMHEALHNHYTQKSLSLSPGK

SEQ ID NO: 184 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 185 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKSEWQQGFVFSCSVMHEALHNHYTQKSLSLSPGK

SEQ ID NO: 186 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 187 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVTKEEWQQGFVFSCSVMHEALHNHYTQKSLSLSPGK

SEQ ID NO: 188 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKEEWQQGFVFSCSVMHEALHNHYTQKSLSLSPGK

SEQ ID NO: 189 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 190 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWASYKTTPPVLDSDGSFFLYSKLTVTKEEWQQGFVFSCSVMHEALHNHYTQKSLSLSPGK

SEQ ID NO: 191 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVSYKTTPPVLDSDGSFFLYSKLTVTKEEWQQGFVFSCSVMHEALHNHYTQKSLSLSPGK

SEQ ID NO: 192 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKEEWQQGFVFSCSVMHEALHNHYTQKSLSLSPGK

SEQ ID NO: 193 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWASYKTTPPVLDSDGSFFLYSKLTVTKEEWQQGFVFSCSVMHEALHNHYTQKSLSLSPGK

SEQ ID NO: 194 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVSYKTTPPVLDSDGSFFLYSKLTVTKEEWQQGFVFSCSVMHEALHNHYTQKSLSLSPGK

SEQ ID NO: 195 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSSYKTTPPVLDSDGSFFLYSKLTVTKEEWQQGFVFSCSVMHEALHNHYTQKSLSLSPGK

SEQ ID NO: 196 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWASYKTTPPVLDSDGSFFLYSKLTVTKEEWQQGFVFSCSVMHEALHNHYTQKSLSLSPGK

SEQ ID NO: 197 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVSYKTTPPVLDSDGSFFLYSKLTVTKEEWQQGFVFSCSVMHEALHNHYTQKSLSLSPGK

SEQ ID NO: 198 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVSKEEWQQGFVFSCSVMHEALHNHYTQKSLSLSPGK

SEQ ID NO: 199 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWASYKTTPPVLDSDGSFFLYSKLTVTKEEWQQGFVFSCSVMHEALHNHYTQKSLSLSPGK

SEQ ID NO: 200 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVSYKTTPPVLDSDGSFFLYSKLTVTKEEWQQGFVFSCSVMHEALHNHYTQKSLSLSPGK

SEQ ID NO: 201 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVTKEEWQQGFVFSCSVMHEALHNHYTQKSLSLSPGK

SEQ ID NO: 202 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVMHEALHNHYTQKSLSLSPGK

SEQ ID NO: 203 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 204 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 205 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWANYKTTPPVLDSDGSFFLYSKLTVTKEEWQQGFVFSCSVMHEALHNHYTQKSLSLSPGK

SEQ ID NO: 206 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVTKEEWQQGFVFSCSVMHEALHNHYTQKSLSLSPGK

SEQ ID NO: 207 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWSNYKTTPPVLDSDGSFFLYSKLTVTKEEWQQGFVFSCSVMHEALHNHYTQKSLSLSPGK

SEQ ID NO: 208 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWANYKTTPPVLDSDGSFFLYSKLTVTKEEWQQGFVFSCSVMHEALHNHYTQKSLSLSPGK

SEQ ID NO: 209 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWVNYKTTPPVLDSDGSFFLYSKLTVTKEEWQQGFVFSCSVMHEALHNHYTQKSLSLSPGK

SEQ ID NO: 210 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSNYKTTPPVLDSDGSFFLYSKLTVSKEEWQQGFVFSCSVMHEALHNHYTQKSLSLSPGK

SEQ ID NO: 211 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWANYKTTPPVLDSDGSFFLYSKLTVTKEEWQQGFVFSCSVMHEALHNHYTQKSLSLSPGK

SEQ ID NO: 212 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESFGTEWVNYKTTPPVLDSDGSFFLYSKLTVTKEEWQQGFVFSCSVMHEALHNHYTQKSLSLSPGK

SEQ ID NO: 213 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWSSYKTTPPVLDSDGSFFLYSKLTVTKEEWQQGFVFSCSVMHEALHNHYTQKSLSLSPGK

SEQ ID NO: 214 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVMHEALHNHYTQKSLSLSPGK

SEQ ID NO: 215 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWVSYKTTPPVLDSDGSFFLYSKLTVTKEEWQQGFVFSCSVMHEALHNHYTQKSLSLSPGK

SEQ ID NO: 216 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVSKEEWQQGFVFSCSVMHEALHNHYTQKSLSLSPGK

SEQ ID NO: 217 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWASYKTTPPVLDSDGSFFLYSKLTVTKEEWQQGFVFSCSVMHEALHNHYTQKSLSLSPGK

SEQ ID NO: 218 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESFGTEWVSYKTTPPVLDSDGSFFLYSKLTVTKEEWQQGFVFSCSVMHEALHNHYTQKSLSLSPGK

SEQ ID NO: 219 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKSEWQQGFVFSCSVMHEALHNHYTQKSLSLSPGK

SEQ ID NO: 220 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVAKSTWQQGWVFSCSVMHEALHNHYTQKSLSLSPGK

SEQ ID NO: 221 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSHYKTTPPVLDSDGSFFLYSKLTVSKSEWQQGYVFSCSVMHEALHNHYTQKSLSLSPGK

SEQ ID NO: 222 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSQYKTTPPVLDSDGSFFLYSKLTVEKSDWQQGHVFSCSVMHEALHNHYTQKSLSLSPGK

SEQ ID NO: 223 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESVGTPWALYKTTPPVLDSDGSFFLYSKLTVLKSEWQQGWVFSCSVMHEALHNHYTQKSLSLSPGK

SEQ ID NO: 224 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTVWSKYKTTPPVLDSDGSFFLYSKLTVSKSEWQQGFVFSCSVMHEALHNHYTQKSLSLSPGK

SEQ ID NO: 225 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYKTTPPVLDSDGSFFLYSKLTVPKSTWQQGWVFSCSVMHEALHNHYTQKSLSLSPGK

SEQ ID NO: 226 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVGYKTTPPVLDSDGSFFLYSKLTVPKSTWQQGWVFSCSVMHEALHNHYTQKSLSLSPGK

SEQ ID NO: 227 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESMGHVWVGYKTTPPVLDSDGSFFLYSKLTVDKSTWQQGWVFSCSVMHEALHNHYTQKSLSLSPGK

SEQ ID NO: 228 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGLVWVFSKTTPPVLDSDGSFFLYSKLTVPKSTWQQGWVFSCSVMHEALHNHYTQKSLSLSPGK

SEQ ID NO: 229 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVTKSEWQQGFVFSCSVMHEALHNHYTQKSLSLSPGK

SEQ ID NO: 230 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKSEWQQGFVFSCSVMHEALHNHYTQKSLSLSPGK

SEQ ID NO: 231 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVGYKTTPPVLDSDGSFFLYSKLTVSKSEWQQGWVFSCSVMHEALHNHYTQKSLSLSPGK

SEQ ID NO: 232 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVATKTTPPVLDSDGSFFLYSKLTVPKSTWQQGWVFSCSVMHEALHNHYTQKSLSLSPGK

SEQ ID NO: 233 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGPVWVHTKTTPPVLDSDGSFFLYSKLTVPKSTWQQGWVFSCSVMHEALHNHYTQKSLSLSPGK

SEQ ID NO: 234 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVDQKTTPPVLDSDGSFFLYSKLTVPKSTWQQGWVFSCSVMHEALHNHYTQKSLSLSPGK

SEQ ID NO: 235 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQKTTPPVLDSDGSFFLYSKLTVPKSTWQQGWVFSCSVMHEALHNHYTQKSLSLSPGK

SEQ ID NO: 236 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNFKTTPPVLDSDGSFFLYSKLTVPKSTWQQGWVFSCSVMHEALHNHYTQKSLSLSPGK

SEQ ID NO: 237 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYKTTPPVLDSDGSFFLYSKLTVPKSTWQQGWVFSCSVMHEALHNHYTQKSLSLSPGK

SEQ ID NO: 238 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESLGHVWAVYKTTPPVLDSDGSFFLYSKLTVPKSTWQQGWVFSCSVMHEALHNHYTQKSLSLSPGK

SEQ ID NO: 239 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVYWESLGHVWAVYKTTPPVLDSDGSFFLYSKLTVPKSTWQQGWVFSCSVMHEALHNHYTQKSLSLSPGK

SEQ ID NO: 240 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYQTTPPVLDSDGSFFLYSKLTVPKSTWQQGWVFSCSVMHEALHNHYTQKSLSLSPGK

SEQ ID NO: 241 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYFTTPPVLDSDGSFFLYSKLTVPKSTWQQGWVFSCSVMHEALHNHYTQKSLSLSPGK

SEQ ID NO: 242 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWAVYHTTPPVLDSDGSFFLYSKLTVPKSTWQQGWVFSCSVMHEALHNHYTQKSLSLSPGK

SEQ ID NO: 243 - protein, 217 aa, Artificial Sequence; identical to SEQ ID NO: 237
  source: /note="Description of Artificial Sequence: Synthetic polypeptide"

SEQ ID NO: 244 - protein, 217 aa, Artificial Sequence; identical to SEQ ID NO: 240
  source: /note="Description of Artificial Sequence: Synthetic polypeptide"

SEQ ID NO: 245 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWAVYQTTPPVLDSDGSFFLYSKLTVPKSTWQQGWVFSCSVMHEALHNHYTQKSLSLSPGK

SEQ ID NO: 246 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQKTTPPVLDSDGSFFLYSKLTVPKSTWQQGWVFSCSVMHEALHNHYTQKSLSLSPGK

SEQ ID NO: 247 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESLGHVWVNQQTTPPVLDSDGSFFLYSKLTVPKSTWQQGWVFSCSVMHEALHNHYTQKSLSLSPGK

SEQ ID NO: 248 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESLGHVWVNQQTTPPVLDSDGSFFLYSKLTVPKSTWQQGWVFSCSVMHEALHNHYTQKSLSLSPGK

SEQ ID NO: 249 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKSEWQQGFVFSCSVMHEALHNHYTQKSLSLSPGK

SEQ ID NO: 250 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYQTTPPVLDSDGSFFLYSKLTVTKSEWQQGFVFSCSVMHEALHNHYTQKSLSLSPGK

SEQ ID NO: 251 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYQTTPPVLDSDGSFFLYSKLTVTKSEWQQGFVFSCSVMHEALHNHYTQKSLSLSPGK

SEQ ID NO: 252 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYKTTPPVLDSDGSFFLYSKLTVTKSEWQQGFVFSCSVMHEALHNHYTQKSLSLSPGK

SEQ ID NO: 253 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKSEWQQGFVFSCSVMHEALHNHYTQKSLSLSPGK

SEQ ID NO: 254 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCSVMHEALHNHYTQKSLSLSPGK

SEQ ID NO: 255 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTGEEWQQGFVFSCSVMHEALHNHYTQKSLSLSPGK

SEQ ID NO: 256 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFSCWVMHEALHNHYTQKSLSLSPGK

SEQ ID NO: 257 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCWVMHEALHNHYTQKSLSLSPGK

SEQ ID NO: 258 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCWVMHEALHNHYTQKSLSLSPGK

SEQ ID NO: 259 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFTCGVMHEALHNHYTQKSLSLSPGK

SEQ ID NO: 260 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFECWVMHEALHNHYTQKSLSLSPGK

SEQ ID NO: 261 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTREEWQQGFVFKCWVMHEALHNHYTQKSLSLSPGK

SEQ ID NO: 262 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTPEEWQQGFVFKCWVMHEALHNHYTQKSLSLSPGK

SEQ ID NO: 263 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFSCSVMHEALHNHYTQKSLSLSPGK

SEQ ID NO: 264 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFSCSVMHEALHNHYTQKSLSLSPGK

SEQ ID NO: 265 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCWVMHEALHNHYTQKSLSLSPGK

SEQ ID NO: 266 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTGEEWQQGFVFTCWVMHEALHNHYTQKSLSLSPGK

SEQ ID NO: 267 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYRTTPPVLDSDGSFFLYSKLTVTREEWQQGFVFTCGVMHEALHNHYTQKSLSLSPGK

SEQ ID NO: 268 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWSSYRTTPPVLDSDGSFFLYSKLTVTKEEWQQGFVFSCSVMHEALHNHYTQKSLSLSPGK

SEQ ID NO: 269 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 270 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 271 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 272 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 273 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 274 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 275 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 276 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 277 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 278 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFDMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 279 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEYVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 280 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFEMVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 281 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRFELVTTLPPSRDELTKNQVSLTCLVKGFYPSDIAVEWESNGQPENNYKTTPPVLDSDGSFFLYSKLTVDKSRWQQGNVFSCSVMHEALHNHYGFHDLSLSPGK

SEQ ID NO: 282 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVEFIWYVDGVDVRYEWQLPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVGFVWYVDGVPVSWEWYWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVQFDWYVDGVMVRREWHRPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVSFEWYVDGVPVRWEWQWPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVAFTWYVDGVPVRWEWQNPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 217 aa, Artificial Sequence
  source: /note="Description of Artificial Sequence: Synthetic polypeptide"
APELLGGPSVFLFPPKPKDTLMISRTPEVTCVVVDPQTPPWEVKFNWYVDGVEVHNAKTKPREEEYYTYYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 217 aa, Artificial Sequence
  source: /note="Description of Artificial Sequence: Synthetic polypeptide"
APELLGGPSVFLFPPKPKDTLMISRTPEVTCVVVDPPSPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 217 aa, Artificial Sequence
  source: /note="Description of Artificial Sequence: Synthetic polypeptide"
APELLGGPSVFLFPPKPKDTLMISRTPEVTCVVVDPQTPPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 217 aa, Artificial Sequence
  source: /note="Description of Artificial Sequence: Synthetic polypeptide"
APELLGGPSVFLFPPKPKDTLMISRTPEVTCVVVDFRGPPWEVKFNWYVDGVEVHNAKTKPREEEYYHDYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 217 aa, Artificial Sequence
  source: /note="Description of Artificial Sequence: Synthetic polypeptide"
APELLGGPSVFLFPPKPKDTLMISRTPEVTCVVVDPQTVPWEVKFNWYVDGVEVHNAKTKPREEEYYSNYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 217 aa, Artificial Sequence
  source: /note="Description of Artificial Sequence: Synthetic polypeptide"
APELLGGPSVFLFPPKPKDTLMISRTPEVTCVVVDVSVPPRMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 217 aa, Artificial Sequence
  source: /note="Description of Artificial Sequence: Synthetic polypeptide"
APELLGGPSVFLFPPKPKDTLMISRTPEVTCVVVDVSVPPWMVKFNWYVDGVEVHNAKTKSLTSQHNSTVRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 217 aa, Artificial Sequence
  source: /note="Description of Artificial Sequence: Synthetic polypeptide"
APELLGGPSVFLFPPKPKDTLMISRTPEVTCVVVDVSDMWEYVKFNWYVDGVEVHNAKTKPWVKQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 217 aa, Artificial Sequence
  source: /note="Description of Artificial Sequence: Synthetic polypeptide"
APELLGGPSVFLFPPKPKDTLMISRTPEVTCVVVDVSDDWTWVKFNWYVDGVEVHNAKTKPWIAQPNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 217 aa, Artificial Sequence
  source: /note="Description of Artificial Sequence: Synthetic polypeptide"
APELLGGPSVFLFPPKPKDTLMISRTPEVTCVVVDVSDDWEWVKFNWYVDGVEVHNAKTKPWKLQLNSTWRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 217 aa, Artificial Sequence
  source: /note="Description of Artificial Sequence: Synthetic polypeptide"
APELLGGPSVFLFPPKPKDTLMISRTPEVTCVVVDVSHEDPWVWFYWYVDGVEVHNAKTKPREEQYNSTYRVVSVLTVLHQDWLNGKEYKCSVVNIALWWSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 217 aa, Artificial Sequence
  source: /note="Description of Artificial Sequence: Synthetic polypeptide"
APELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALTWKIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 217 aa, Artificial Sequence
  source: /note="Description of Artificial Sequence: Synthetic polypeptide"
APELLGGPSVFLFPPKPKDTLMISRTPEVTCVVVDVSHEDPVVGFRWYVDGVEVHNAKTKPREEQYNSTYRVVSVLTVLHQDWLNGKEYKCRVSNSALSWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 217 aa, Artificial Sequence
  source: /note="Description of Artificial Sequence: Synthetic polypeptide"
APELLGGPSVFLFPPKPKDTLMISRTPEVTCVVVDVSHEDPIVGFRWYVDGVEVHNAKTKPREEQYNSTYRVVSVLTVLHQDWLNGKEYKCRVSNSALRWRIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 217 aa, Artificial Sequence
  source: /note="Description of Artificial Sequence: Synthetic polypeptide"
APELLGGPSVFLFPPKPKDTLMISRTPEVTCVVVDVSHEDPAVGFEWYVDGVEVHNAKTKPREEQYNSTYRVVSVLTVLHQDWLNGKEYKCQVFNWALDWVIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 217 aa, Homo sapiens
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 304 - protein, 15 aa, Homo sapiens
EPKSCDKTHTCPPCP

SEQ ID NO: 305 - protein, 501 aa, Homo sapiens
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 306 - protein, 480 aa, Artificial Sequence
  source: /note="Description of Artificial Sequence: Synthetic polypeptide"
TQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 307 - protein, 456 aa, Artificial Sequence
  source: /note="Description of Artificial Sequence: Synthetic polypeptide"
ETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 308 - protein, 7 aa, Artificial Sequence
  source: /note="Description of Artificial Sequence: Synthetic peptide"
  MOD_RES (2)..(2): Any amino acid
YXTEWSS

SEQ ID NO: 309 - protein, 9 aa, Artificial Sequence
  source: /note="Description of Artificial Sequence: Synthetic peptide"
  MOD_RES (2)..(3): Any amino acid
  MOD_RES (5)..(8): Any amino acid
TXXEXXXXF

SEQ ID NO: 310 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARVTMTRDTSTSTTYMELSSLRSEDTAVYYCARSGVAFPYWGQGTLVTVSS

SEQ ID NO: 311 - protein, 116 aa, Artificial Sequence
  source: /note="Description of Artificial Sequence: Synthetic polypeptide"
QVQLVQSGAEVKKPGASVKVSCKASGYTFTNFWIHWLRQAPGQGLEWMGMIDPSDSYTKYNQKFKARVTMTRDTSTSTTYMELSSLRSEDTAVYYCARSGVAFPYWGQGTLVTVSS

SEQ ID NO: 312 - protein, 116 aa, Artificial Sequence
  source: /note="Description of Artificial Sequence: Synthetic polypeptide"
QVQLVQSGAEVKKPGASVKVSCKASGYTFTNFWIHWLRQAPGQGLEWMGMIDPSDSYTKYNQKFKARVTMTVDTSTSTTYMELSSLRSEDTAVYYCARSGVAFPYWGQGTLVTVSS

SEQ ID NO: 313 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTRDTSTSTVYMELSSLRSEDTAVYYCARSGVAFPYWGQGTLVTVSS

SEQ ID NO: 314 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGVAFPYWGQGTLVTVSS

SEQ ID NO: 315 - protein, 116 aa, Artificial Sequence
  source: /note="Description of Artificial Sequence: Synthetic polypeptide"
QVQLVQSGAEVKKPGASVKVSCKASGYTFTNFWIHWLRQAPGQGLEWMGMIDPSDSYTKYNQKFKARATLTVDTSTSTTYMELSSLRSEDTAVYYCARSGVAFPYWGQGTLVTVSS

SEQ ID NO: 316 - protein, 107 aa, Artificial Sequence
  source: /note="Description of Artificial Sequence: Synthetic polypeptide"
DIQMTQSPSSLSASVGDRVTITCKASQDVGRNVAWYQQKPGKAPKLLIYSASHRYSGVPSRFSGSGSGTDFTLTISSLQPEDFATYYCQQYNSYPYTFGQGTKVEIK

SEQ ID NO: 317 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKLLIYSASHRYSGVPSRFSGSGSGTDFTLTISSLQPEDFATYYCQQYNSYPYTFGQGTKVEIK

SEQ ID NO: 318 - protein, 107 aa, Artificial Sequence
  source: /note="Description of Artificial Sequence: Synthetic polypeptide"
DIQMTQSPSSLSASVGDRVTITCKASQDVGRNVAWYQQKPGKAPKSLIYSASHRYSGVPSRFSGSGSGTDFTLTISSLQPEDFATYYCQQYNSYPYTFGQGTKVEIK

SEQ ID NO: 319 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYYCQQYNSYPYTFGQGTKVEIK

SEQ ID NO: 320 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYNSYPYTFGQGTKVEIK

SEQ ID NO: 321 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 322 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 323 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 324 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 325 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 326 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVMHEALHNHYTQKSLSLSPGK

SEQ ID NO: 327 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 328 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 329 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 330 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 331 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 332 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVMHEALHNHYTQKSLSLSPGK

SEQ ID NO: 333 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 334 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 335 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 336 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 337 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 338 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVMHEALHNHYTQKSLSLSPGK

SEQ ID NO: 339 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 340 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 341 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 342 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 343 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 344 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVMHEALHNHYTQKSLSLSPGK

SEQ ID NO: 345 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 346 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 347 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 348 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 349 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 350 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVMHEALHNHYTQKSLSLSPGK

SEQ ID NO: 351 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 352 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 353 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 354 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 355 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 356 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVMHEALHNHYTQKSLSLSPGK

SEQ ID NO: 357 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 358 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 359 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 360 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 361 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 362 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVMHEALHNHYTQKSLSLSPGK

SEQ ID NO: 363 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 364 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 365 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 366 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 367 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 368 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVMHEALHNHYTQKSLSLSPGK

SEQ ID NO: 369 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 370 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 371 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 372 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 373 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 374 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVMHEALHNHYTQKSLSLSPGK

SEQ ID NO: 375 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 376 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 377 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 378 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 379 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 380 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVMHEALHNHYTQKSLSLSPGK

SEQ ID NO: 381 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 382 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 383 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 384 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 385 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 386 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVMHEALHNHYTQKSLSLSPGK

SEQ ID NO: 387 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 388 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 389 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 390 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 391 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 392 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVMHEALHNHYTQKSLSLSPGK

SEQ ID NO: 393 - protein, 11 aa, Artificial Sequence
  source: /note="Description of Artificial Sequence: Synthetic peptide"
  MOD_RES (5)..(5): Any amino acid
  MOD_RES (8)..(8): Any amino acid
KASQXVGXNVA

SEQ ID NO: 394 - protein, 11 aa, Artificial Sequence
  source: /note="Description of Artificial Sequence: Synthetic peptide"
  VARIANT (5)..(5): /replace="Asn"
  VARIANT (8)..(8): /replace="Ser" or "Thr"
  SITE (1)..(11): /note="Variant residues given in the sequence have no preference with respect to those in the annotations for variant positions"
KASQDVGRNVA

SEQ ID NO: 395 - protein, 7 aa, Artificial Sequence
  source: /note="Description of Artificial Sequence: Synthetic peptide"
SASHYYS

SEQ ID NO: 396 - protein, 7 aa, Artificial Sequence
  source: /note="Description of Artificial Sequence: Synthetic peptide"
SASHNYS

SEQ ID NO: 397 - protein, 7 aa, Artificial Sequence
  source: /note="Description of Artificial Sequence: Synthetic peptide"
SASHMYS

SEQ ID NO: 398 - protein, 7 aa, Artificial Sequence
  source: /note="Description of Artificial Sequence: Synthetic peptide"
SASHQYS

SEQ ID NO: 399 - protein, 7 aa, Artificial Sequence
  source: /note="Description of Artificial Sequence: Synthetic peptide"
SASHKYS

SEQ ID NO: 400 - protein, 7 aa, Artificial Sequence
  source: /note="Description of Artificial Sequence: Synthetic peptide"
SASHLYS

SEQ ID NO: 401 - protein, 7 aa, Artificial Sequence
  source: /note="Description of Artificial Sequence: Synthetic peptide"
  MOD_RES (4)..(5): Any amino acid
SASXXYS

SEQ ID NO: 402 - protein, 7 aa, Artificial Sequence
  source: /note="Description of Artificial Sequence: Synthetic peptide"
  VARIANT (4)..(4): /replace="Tyr"
  VARIANT (5)..(5): /replace="Tyr" or "Asn" or "Met" or "Gln" or "Lys" or "Leu" or "Trp"
  SITE (1)..(7): /note="Variant residues given in the sequence have no preference with respect to those in the annotations for variant positions"
SASHRYS

SEQ ID NO: 403 - protein, 9 aa, Artificial Sequence
  source: /note="Description of Artificial Sequence: Synthetic peptide"
QQYQSYPYT

SEQ ID NO: 404 - protein, 9 aa, Artificial Sequence
  source: /note="Description of Artificial Sequence: Synthetic peptide"
QQYNAYPYT

SEQ ID NO: 405 - protein, 9 aa, Artificial Sequence
  source: /note="Description of Artificial Sequence: Synthetic peptide"
QQYYSYPYT

SEQ ID NO: 406 - protein, 9 aa, Artificial Sequence
  source: /note="Description of Artificial Sequence: Synthetic peptide"
QQYYSYAYT

SEQ ID NO: 407 - protein, 9 aa, Artificial Sequence
  source: /note="Description of Artificial Sequence: Synthetic peptide"
  MOD_RES (4)..(5): Any amino acid
  MOD_RES (7)..(7): Any amino acid
QQYXXYXYT

SEQ ID NO: 408 - protein, 9 aa, Artificial Sequence
  source: /note="Description of Artificial Sequence: Synthetic peptide"
  VARIANT (4)..(4): /replace="Ser" or "Gln" or "Tyr"
  VARIANT (5)..(5): /replace="Ala"
  VARIANT (7)..(7): /replace="Ala" or "Met"
  SITE (1)..(9): /note="Variant residues given in the sequence have no preference with respect to those in the annotations for variant positions"
QQYNSYPYT

SEQ ID NO: 409 - protein, 10 aa, Artificial Sequence
  source: /note="Description of Artificial Sequence: Synthetic peptide"
GYTFNNFWIH

SEQ ID NO: 410 - protein, 10 aa, Artificial Sequence
  source: /note="Description of Artificial Sequence: Synthetic peptide"
GYTFTNYWIH

SEQ ID NO: 411 - protein, 10 aa, Artificial Sequence
  source: /note="Description of Artificial Sequence: Synthetic peptide"
GYTFNSYWIH

SEQ ID NO: 412 - protein, 10 aa, Artificial Sequence
  source: /note="Description of Artificial Sequence: Synthetic peptide"
GYTFTNFYIH

SEQ ID NO: 413 - protein, 10 aa, Artificial Sequence
  source: /note="Description of Artificial Sequence: Synthetic peptide"
  MOD_RES (5)..(9): Any amino acid
GYTFXXXXXH

SEQ ID NO: 414 - protein, 10 aa, Artificial Sequence
  source: /note="Description of Artificial Sequence: Synthetic peptide"
  VARIANT (5)..(5): /replace="Asn"
  VARIANT (6)..(6): /replace="Ser"
  VARIANT (7)..(7): /replace="Tyr"
  VARIANT (8)..(8): /replace="Tyr"
  VARIANT (9)..(9): /replace="Met"
  SITE (1)..(10): /note="Variant residues given in the sequence have no preference with respect to those in the annotations for variant positions"
GYTFTNFWIH

SEQ ID NO: 415 - protein, 17 aa, Artificial Sequence
  source: /note="Description of Artificial Sequence: Synthetic peptide"
IIDPSDSYTKYNQKFKA

SEQ ID NO: 416 - protein, 17 aa, Artificial Sequence
  source: /note="Description of Artificial Sequence: Synthetic peptide"
MIDPSSSYTKYNQKFKA

SEQ ID NO: 417 - protein, 17 aa, Artificial Sequence
  source: /note="Description of Artificial Sequence: Synthetic peptide"
MIDPSESYTKYNQKFKA

SEQ ID NO: 418 - protein, 17 aa, Artificial Sequence
  source: /note="Description of Artificial Sequence: Synthetic peptide"
MIDPSGSYTKYNQKFKA

SEQ ID NO: 419 - protein, 17 aa, Artificial Sequence
  source: /note="Description of Artificial Sequence: Synthetic peptide"
MIDPSDAYTKYNQKFKA

SEQ ID NO: 420 - protein, 17 aa, Artificial Sequence
  source: /note="Description of Artificial Sequence: Synthetic peptide"
MIDPDSSYTKYNQKFKA

SEQ ID NO: 421 - protein, 17 aa, Artificial Sequence
  source: /note="Description of Artificial Sequence: Synthetic peptide"
  MOD_RES (1)..(1): Any amino acid
  MOD_RES (5)..(11): Any amino acid
  MOD_RES (14)..(15): Any amino acid
  MOD_RES (17)..(17): Any amino acid
XIDPXXXXXXXNQXXKX

SEQ ID NO: 422 - protein, 17 aa, Artificial Sequence
  source: /note="Description of Artificial Sequence: Synthetic peptide"
  VARIANT (1)..(1): /replace="Ile"
  VARIANT (5)..(5): /replace="Asp"
  VARIANT (6)..(6): /replace="Ser" or "Glu" or "Gly" or "Ala"
  VARIANT (7)..(7): /replace="Ala" or "Thr" or "Asn" or "Asp"
  VARIANT (8)..(8): /replace="Asp"
  VARIANT (9)..(9): /replace="Ile"
  VARIANT (10)..(10): /replace="Asn"
  VARIANT (11)..(11): /replace="Phe" or "Asn"
  VARIANT (14)..(14): /replace="Asn"
  VARIANT (15)..(15): /replace="Leu"
  VARIANT (17)..(17): /replace="Gly" or "Asp"
  SITE (1)..(17): /note="Variant residues given in the sequence have no preference with respect to those in the annotations for variant positions"
MIDPSDSYTKYNQKFKA

SEQ ID NO: 423 - protein, 9 aa, Artificial Sequence
  source: /note="Description of Artificial Sequence: Synthetic peptide"
ARSGVALPS

SEQ ID NO: 424 - protein, 9 aa, Artificial Sequence
  source: /note="Description of Artificial Sequence: Synthetic peptide"
ARSGVSLPY

SEQ ID NO: 425 - protein, 9 aa, Artificial Sequence
  source: /note="Description of Artificial Sequence: Synthetic peptide"
ARSGASLPY

SEQ ID NO: 426 - protein, 9 aa, Artificial Sequence
  source: /note="Description of Artificial Sequence: Synthetic peptide"
ARSGAALPY

SEQ ID NO: 427 - protein, 9 aa, Artificial Sequence
  source: /note="Description of Artificial Sequence: Synthetic peptide"
ARSGGALPY

SEQ ID NO: 428 - protein, 9 aa, Artificial Sequence
  source: /note="Description of Artificial Sequence: Synthetic peptide"
  MOD_RES (5)..(7): Any amino acid
  MOD_RES (9)..(9): Any amino acid
ARSGXXXPX

SEQ ID NO: 429 - protein, 9 aa, Artificial Sequence
  source: /note="Description of Artificial Sequence: Synthetic peptide"
  VARIANT (5)..(5): /replace="Ala" or "Gly"
  VARIANT (6)..(6): /replace="Ser"
  VARIANT (7)..(7): /replace="Leu"
  VARIANT (9)..(9): /replace="Ser"
  SITE (1)..(9): /note="Variant residues given in the sequence have no preference with respect to those in the annotations for variant positions"
ARSGVAFPY

SEQ ID NO: 430 - protein, 7 aa, Artificial Sequence
  source: /note="Description of Artificial Sequence: Synthetic peptide"
  MOD_RES (5)..(5): Any amino acid
SASHXYS

SEQ ID NO: 431 - protein, 7 aa, Artificial Sequence
  source: /note="Description of Artificial Sequence: Synthetic peptide"
  VARIANT (5)..(5): /replace="Tyr" or "Asn" or "Met" or "Gln" or "Lys" or "Leu"
  SITE (1)..(7): /note="Variant residues given in the sequence have no preference with respect to those in the annotations for variant positions"
SASHRYS

SEQ ID NO: 432 - protein, 9 aa, Artificial Sequence
  source: /note="Description of Artificial Sequence: Synthetic peptide"
  VARIANT (4)..(4): /replace="Ser" or "Gln" or "Tyr"
  VARIANT (5)..(5): /replace="Ala"
  VARIANT (7)..(7): /replace="Ala"
  SITE (1)..(9): /note="Variant residues given in the sequence have no preference with respect to those in the annotations for variant positions"
QQYNSYPYT

SEQ ID NO: 433 - protein, 10 aa, Artificial Sequence
  source: /note="Description of Artificial Sequence: Synthetic peptide"
  MOD_RES (5)..(8): Any amino acid
GYTFXXXXIH

SEQ ID NO: 434 - protein, 10 aa, Artificial Sequence
  source: /note="Description of Artificial Sequence: Synthetic peptide"
  VARIANT (5)..(5): /replace="Asn"
  VARIANT (6)..(6): /replace="Ser"
  VARIANT (7)..(7): /replace="Tyr"
  VARIANT (8)..(8): /replace="Tyr"
  SITE (1)..(10): /note="Variant residues given in the sequence have no preference with respect to those in the annotations for variant positions"
GYTFTNFWIH

SEQ ID NO: 435 - protein, 17 aa, Artificial Sequence
  source: /note="Description of Artificial Sequence: Synthetic peptide"
  MOD_RES (1)..(1): Any amino acid
  MOD_RES (5)..(7): Any amino acid
XIDPXXXYTKYNQKFKA

SEQ ID NO: 436 - protein, 17 aa, Artificial Sequence
  source: /note="Description of Artificial Sequence: Synthetic peptide"
  VARIANT (1)..(1): /replace="Ile"
  VARIANT (5)..(5): /replace="Asp"
  VARIANT (6)..(6): /replace="Ser" or "Glu" or "Gly"
  VARIANT (7)..(7): /replace="Ala"
  SITE (1)..(17): /note="Variant residues given in the sequence have no preference with respect to those in the annotations for variant positions"
MIDPSDSYTKYNQKFKA

SEQ ID NO: 437 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHYYSGVPSRFSGSGSGTDFTLTISSLQPEDFATYFCQQYNSYPYTFGQGTKVEIK

SEQ ID NO: 438 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHNYSGVPSRFSGSGSGTDFTLTISSLQPEDFATYFCQQYNSYPYTFGQGTKVEIK

SEQ ID NO: 439 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHMYSGVPSRFSGSGSGTDFTLTISSLQPEDFATYFCQQYNSYPYTFGQGTKVEIK

SEQ ID NO: 440 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHQYSGVPSRFSGSGSGTDFTLTISSLQPEDFATYFCQQYNSYPYTFGQGTKVEIK

SEQ ID NO: 441 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHKYSGVPSRFSGSGSGTDFTLTISSLQPEDFATYFCQQYNSYPYTFGQGTKVEIK

SEQ ID NO: 442 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHLYSGVPSRFSGSGSGTDFTLTISSLQPEDFATYFCQQYNSYPYTFGQGTKVEIK

SEQ ID NO: 443 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYSSYPYTFGQGTKVEIK

SEQ ID NO: 444 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYQSYPYTFGQGTKVEIK

SEQ ID NO: 445 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYNAYPYTFGQGTKVEIK

SEQ ID NO: 446 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYYSYPYTFGQGTKVEIK

SEQ ID NO: 447 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHRYSGVPSRFSGSGSGTDFTLTISSLQPEDFATYFCQQYYSYAYTFGQGTKVEIK

SEQ ID NO: 448 - protein, 116 aa, Artificial Sequence
  source: /note="Description of Artificial Sequence: Synthetic polypeptide"
QVQLVQSGAEVKKPGASVKVSCKASGYTFNNFWIHWVRQAPGQGLEWMGMIDPSDSYTKYNQKFKARATLTVDTSTSTVYMELSSLRSEDTAVYYCARSGVAFPYWGQGTLVTVSS

SEQ ID NO: 449 - protein, 116 aa, Artificial Sequence
  source: /note="Description of Artificial Sequence: Synthetic polypeptide"
QVQLVQSGAEVKKPGASVKVSCKASGYTFTNYWIHWVRQAPGQGLEWMGMIDPSDSYTKYNQKFKARATLTVDTSTSTVYMELSSLRSEDTAVYYCARSGVAFPYWGQGTLVTVSS

SEQ ID NO: 450 - protein, 116 aa, Artificial Sequence
  source: /note="Description of Artificial Sequence: Synthetic polypeptide"
QVQLVQSGAEVKKPGASVKVSCKASGYTFNSYWIHWVRQAPGQGLEWMGMIDPSDSYTKYNQKFKARATLTVDTSTSTVYMELSSLRSEDTAVYYCARSGVAFPYWGQGTLVTVSS

SEQ ID NO: 451 - protein, 116 aa, Artificial Sequence
  source: /note="Description of Artificial Sequence: Synthetic polypeptide"
QVQLVQSGAEVKKPGASVKVSCKASGYTFTNFYIHWVRQAPGQGLEWMGMIDPSDSYTKYNQKFKARATLTVDTSTSTVYMELSSLRSEDTAVYYCARSGVAFPYWGQGTLVTVSS

SEQ ID NO: 452 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGIIDPSDSYTKYNQKFKARATLTVDTSTSTVYMELSSLRSEDTAVYYCARSGVAFPYWGQGTLVTVSS

SEQ ID NO: 453 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSSSYTKYNQKFKARATLTVDTSTSTVYMELSSLRSEDTAVYYCARSGVAFPYWGQGTLVTVSS

SEQ ID NO: 454 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSESYTKYNQKFKARATLTVDTSTSTVYMELSSLRSEDTAVYYCARSGVAFPYWGQGTLVTVSS

SEQ ID NO: 455 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSGSYTKYNQKFKARATLTVDTSTSTVYMELSSLRSEDTAVYYCARSGVAFPYWGQGTLVTVSS

SEQ ID NO: 456 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDAYTKYNQKFKARATLTVDTSTSTVYMELSSLRSEDTAVYYCARSGVAFPYWGQGTLVTVSS

SEQ ID NO: 457 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGVALPYWGQGTLVTVSS

SEQ ID NO: 458 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGVALPSWGQGTLVTVSS

SEQ ID NO: 459 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGVSLPYWGQGTLVTVSS

SEQ ID NO: 460 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGASLPYWGQGTLVTVSS

SEQ ID NO: 461 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGAALPYWGQGTLVTVSS

SEQ ID NO: 462 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSDSYTKYNQKFKARATLTVDTSTSTVYMELSSLRSEDTAVYYCARSGGALPYWGQGTLVTVSS

SEQ ID NO: 463 - protein, 107 aa, Artificial Sequence
  source: /note="Description of Artificial Sequence: Synthetic polypeptide"
DIQMTQSPSSLSASVGDRVTITCKASQDVGRNVAWYQQKPGKSPKSLIYSASHYYSGVPSRFSGSGSGTDFTLTISSLQPEDFATYFCQQYYSYPYTFGQGTKVEIK

SEQ ID NO: 464 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPSSSYTKYNQKFKARATLTVDTSTSTVYMELSSLRSEDTAVYYCARSGASLPYWGQGTLVTVSS

SEQ ID NO: 465 - protein, 116 aa, Artificial Sequence
  source: /note="Description of Artificial Sequence: Synthetic polypeptide"
QVQLVQSGAEVKKPGASVKVSCKASGYTFTNFWIHWVRQAPGQGLEWMGMIDPDSSYTKYNQKFKARATLTVDTSTSTVYMELSSLRSEDTAVYYCARSGASLPYWGQGTLVTVSS

SEQ ID NO: 466 - protein, 12 aa, Artificial Sequence
  source: /note="Description of Artificial Sequence: Synthetic peptide"
  VARIANT (1)..(1): /replace="Thr"
  VARIANT (3)..(3): /replace="Ala" or "Arg"
  VARIANT (4)..(4): /replace="Tyr" or "Ile" or "Ser"
  VARIANT (5)..(5): /replace="Arg"
  VARIANT (6)..(6): /replace="Thr" or "Leu"
  VARIANT (7)..(7): /replace="Gly"
  VARIANT (8)..(8): /replace="His"
  VARIANT (9)..(9): /replace="Val" or "Tyr"
  VARIANT (11)..(11): /replace="Ala" or "Ser" or "Pro"
  SITE (1)..(12): /note="Variant residues given in the sequence have no preference with respect to those in the annotations for variant positions"
VRGGYSNYWFDY

SEQ ID NO: 467 - protein, 11 aa, Artificial Sequence
  source: /note="Description of Artificial Sequence: Synthetic peptide"
  VARIANT (5)..(5): /replace="Asn"
  VARIANT (7)..(7): /replace="Ser"
  VARIANT (8)..(8): /replace="Arg" or "Ser"
  VARIANT (9)..(9): /replace="Ala"
  SITE (1)..(11): /note="Variant residues given in the sequence have no preference with respect to those in the annotations for variant positions"
KASQDVGTNVA

SEQ ID NO: 468 - protein, 13 aa, Artificial Sequence
  source: /note="Description of Artificial Sequence: Synthetic peptide"
  VARIANT (3)..(3): /replace="Ile"
  VARIANT (9)..(9): /replace="Tyr"
  VARIANT (13)..(13): /replace="Glu"
  SITE (1)..(13): /note="Variant residues given in the sequence have no preference with respect to those in the annotations for variant positions"
QSLVHSNGNTYLH

SEQ ID NO: 469 - protein, 8 aa, Artificial Sequence
  source: /note="Description of Artificial Sequence: Synthetic peptide"
  VARIANT (2)..(2): /replace="Ser"
  VARIANT (5)..(5): /replace="Lys" or "Asp"
  VARIANT (8)..(8): /replace="His"
  SITE (1)..(8): /note="Variant residues given in the sequence have no preference with respect to those in the annotations for variant positions"
QDISNYLN

SEQ ID NO: 470 - protein, 7 aa, Artificial Sequence
  source: /note="Description of Artificial Sequence: Synthetic peptide"
  VARIANT (1)..(1): /replace="Ala"
  VARIANT (4)..(4): /replace="Arg"
  VARIANT (6)..(6): /replace="Ala"
  SITE (1)..(7): /note="Variant residues given in the sequence have no preference with respect to those in the annotations for variant positions"
YTSNLHS

SEQ ID NO: 471 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 472 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVMHEALHNHYTQKSLSLSPGK

SEQ ID NO: 473 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 474 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSSYKTTPPVLDSDGSFFLYSKLTVSKSEWQQGFVFSCSVMHEALHNHYTQKSLSLSPGK

SEQ ID NO: 475 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVSKEEWQQGFVFSCSVMHEALHNHYTQKSLSLSPGK

SEQ ID NO: 476 - protein, 217 aa, Artificial Sequence; identical to SEQ ID NO: 230
  source: /note="Description of Artificial Sequence: Synthetic polypeptide"

SEQ ID NO: 477 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWVNYKTTPPVLDSDGSFFLYSKLTVSKEEWQQGFVFSCSVMHEALHNHYTQKSLSLSPGK

SEQ ID NO: 478 - protein, 220 aa, Artificial Sequence
  source: /note="Description of Artificial Sequence: Synthetic polypeptide"
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 479 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 480 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 481 - protein, 220 aa, Artificial Sequence
  source: /note="Description of Artificial Sequence: Synthetic polypeptide"
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 482 - protein, 220 aa, Artificial Sequence
  source: /note="Description of Artificial Sequence: Synthetic polypeptide"
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 483 - protein, 220 aa, Artificial Sequence
  source: /note="Description of Artificial Sequence: Synthetic polypeptide"
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVMHEALHNHYTQKSLSLSPGK

SEQ ID NO: 484 - protein, 220 aa, Artificial Sequence
  source: /note="Description of Artificial Sequence: Synthetic polypeptide"
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 485 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 486 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 487 - protein, 220 aa, Artificial Sequence
  source: /note="Description of Artificial Sequence: Synthetic polypeptide"
PCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 488 - protein, 220 aa, Artificial Sequence
  source: /note="Description of Artificial Sequence: Synthetic polypeptide"
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 489 - protein, 220 aa, Artificial Sequence
  source: /note="Description of Artificial Sequence: Synthetic polypeptide"
PCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVMHEALHNHYTQKSLSLSPGK

SEQ ID NO: 490 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 491 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 492 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 493 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 494 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 495 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVMHEALHNHYTQKSLSLSPGK

SEQ ID NO: 496 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 497 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 498 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 499 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 500 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 501 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVMHEALHNHYTQKSLSLSPGK

SEQ ID NO: 502 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 503 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 504 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 505 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 506 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 507 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVMHEALHNHYTQKSLSLSPGK

SEQ ID NO: 508 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 509 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 510 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 511 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 512 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 513 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVMHEALHNHYTQKSLSLSPGK

SEQ ID NO: 514 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 515 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 516 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 517 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 518 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 519 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVMHEALHNHYTQKSLSLSPGK

SEQ ID NO: 520 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 521 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 522 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 523 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 524 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 525 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVMHEALHNHYTQKSLSLSPGK

SEQ ID NO: 526 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 527 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 528 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 529 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVTKEEWQQGFVFSCSVLHEALHSHYTQKSLSLSPGK

SEQ ID NO: 530 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 531 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 532 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVTKEEWQQGFVFSCSVLHEALHSHYTQKSLSLSPGK

SEQ ID NO: 533 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVTKEEWQQGFVFSCSVLHEALHSHYTQKSLSLSPGK

SEQ ID NO: 534 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 535 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 536 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVTKEEWQQGFVFSCSVLHEALHSHYTQKSLSLSPGK

SEQ ID NO: 537 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 538 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 539 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVTKEEWQQGFVFSCSVLHEALHSHYTQKSLSLSPGK

SEQ ID NO: 540 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 541 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 542 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 543 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWVNYKTTPPVLDSDGSFFLYSKLTVTKEEWQQGFVFSCSVLHEALHSHYTQKSLSLSPGK

SEQ ID NO: 544 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 545 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 546 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWVNYKTTPPVLDSDGSFFLVSKLTVTKEEWQQGFVFSCSVLHEALHSHYTQKSLSLSPGK

SEQ ID NO: 547 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 548 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 549 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 550 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVSKEEWQQGFVFSCSVLHEALHSHYTQKSLSLSPGK

SEQ ID NO: 551 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 552 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 553 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVSKEEWQQGFVFSCSVLHEALHSHYTQKSLSLSPGK

SEQ ID NO: 554 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVLWESYGTEWASYKTTPPVLDSDGSFFLYSKLTVTKEEWQQGFVFSCSVLHEALHSHYTQKSLSLSPGK

SEQ ID NO: 555 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 556 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 557 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVLWESYGTEWASYKTTPPVLDSDGSFFLYSKLTVTKEEWQQGFVFSCSVLHEALHSHYTQKSLSLSPGK

SEQ ID NO: 558 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 559 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 560 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVLWESYGTEWASYKTTPPVLDSDGSFFLVSKLTVTKEEWQQGFVFSCSVLHEALHSHYTQKSLSLSPGK

SEQ ID NO: 561 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 562 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 563 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 564 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWSNYKTTPPVLDSDGSFFLYSKLTVTKEEWQQGFVFSCSVLHEALHSHYTQKSLSLSPGK

SEQ ID NO: 565 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 566 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 567 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWSNYKTTPPVLDSDGSFFLVSKLTVTKEEWQQGFVFSCSVLHEALHSHYTQKSLSLSPGK

SEQ ID NO: 568 - protein, 220 aa, Artificial Sequence
  source: /note="Description of Artificial Sequence: Synthetic polypeptide"
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 569 - protein, 220 aa, Artificial Sequence
  source: /note="Description of Artificial Sequence: Synthetic polypeptide"
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 570 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 571 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVWWESYGTEWSSYKTTPPVLDSDGSFFLYSKLTVTKEEWQQGFVFSCSVLHEALHSHYTQKSLSLSPGK

SEQ ID NO: 572 - protein, 220 aa, Artificial Sequence
  source: /note="Description of Artificial Sequence: Synthetic polypeptide"
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 573 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 574 - protein, 220 aa, Artificial Sequence
  source: /note="Description of Artificial Sequence: Synthetic polypeptide"
PCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVWWESYGTEWSSYKTTPPVLDSDGSFFLVSKLTVTKEEWQQGFVFSCSVLHEALHSHYTQKSLSLSPGK

SEQ ID NO: 575 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 576 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 577 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 578 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSSYKTTPPVLDSDGSFFLYSKLTVSKEEWQQGFVFSCSVLHEALHSHYTQKSLSLSPGK

SEQ ID NO: 579 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 580 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 581 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSSYKTTPPVLDSDGSFFLVSKLTVSKEEWQQGFVFSCSVLHEALHSHYTQKSLSLSPGK

SEQ ID NO: 582 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESYGTEWANYKTTPPVLDSDGSFFLYSKLTVSKSEWQQGFVFSCSVLHEALHSHYTQKSLSLSPGK

SEQ ID NO: 583 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 584 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 585 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESYGTEWANYKTTPPVLDSDGSFFLYSKLTVSKSEWQQGFVFSCSVLHEALHSHYTQKSLSLSPGK

SEQ ID NO: 586 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 587 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 588 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESYGTEWANYKTTPPVLDSDGSFFLVSKLTVSKSEWQQGFVFSCSVLHEALHSHYTQKSLSLSPGK

SEQ ID NO: 589 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 590 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 591 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 592 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESFGTEWSNYKTTPPVLDSDGSFFLYSKLTVSKEEWQQGFVFSCSVLHEALHSHYTQKSLSLSPGK

SEQ ID NO: 593 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 594 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 595 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESFGTEWSNYKTTPPVLDSDGSFFLVSKLTVSKEEWQQGFVFSCSVLHEALHSHYTQKSLSLSPGK

SEQ ID NO: 596 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 597 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 598 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 599 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 600 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 601 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 602 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPGK

SEQ ID NO: 603 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 604 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 605 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 606 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 607 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 608 - protein, 217 aa, Artificial Sequence
  source: /note="Description of Artificial Sequence: Synthetic polypeptide"
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 217 aa, Artificial Sequence
  source: /note="Description of Artificial Sequence: Synthetic polypeptide"
APELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 610 - protein, 217 aa, Artificial Sequence
  source: /note="Description of Artificial Sequence: Synthetic polypeptide"
APEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 6 aa, Artificial Sequence
  source: /note="Description of Artificial Sequence: Synthetic 6xHis tag"
HHHHHH

What is claimed is:

1. An isolated antibody or antigen-binding portion thereof that specifically binds to a human beta-secretase 1 (BACE1) protein, wherein the antibody or antigen-binding portion thereof comprises the following complementarity determining regions (CDRs):
   (a) a heavy chain CDR1 (CDR-H1) comprising the amino acid sequence of any one of SEQ ID NOs: 47-50 and 409-412;
   (b) a heavy chain CDR2 (CDR-H2) comprising the amino acid sequence of any one of SEQ ID NOs:72-77 and 415-420;
   (c) a heavy chain CDR3 (CDR-H3) comprising the amino acid sequence of any one of SEQ ID NOs:99, 100, and 423-427;
   (d) a light chain CDR1 (CDR-L1) comprising the amino acid sequence of any one of SEQ ID NOs: 130, 138, 143, and 144;
   (e) a light chain CDR2 (CDR-L2) comprising the amino acid sequence of any one of SEQ ID NOs: 146, 152, 157, and 395-400; and
   (f) a light chain CDR3 (CDR-L3) comprising the amino acid sequence of any one of SEQ ID NOs: 159, 167, 177, and 403-406.

2. The isolated antibody of claim 1, wherein the antibody or antigen-binding portion thereof comprises:
   (a) a CDR-H1, CDR-H2, CDR-H3, CDR-L1, CDR-L2, and CDR-L3 comprising the amino acid sequences of SEQ ID NOs:47, 72, 99, 143, 146, and 159, respectively; or
   (b) a CDR-H1, CDR-H2, CDR-H3, CDR-L1, CDR-L2, and CDR-L3 comprising the amino acid sequences of SEQ ID NOs:50, 77, 100, 144, 146, and 159, respectively; or
   (c) a CDR-H1, CDR-H2, CDR-H3, CDR-L1, CDR-L2, and CDR-L3 comprising the amino acid sequences of SEQ ID NOs:47, 416, 425, 143, 395, and 405, respectively; or
   (d) a CDR-H1, CDR-H2, CDR-H3, CDR-L1, CDR-L2, and CDR-L3 comprising the amino acid sequences of SEQ ID NOs:47, 420, 425, 143, 395, and 405, respectively.

3. The isolated antibody of claim 1, wherein the antibody or antigen-binding portion thereof comprises a heavy chain variable region comprising an amino acid sequence that has at least 90% sequence identity to any one of SEQ ID NOs:23-28, 310-315, 448-462, and 464-465.

4. The isolated antibody of claim 1, wherein the antibody or antigen-binding portion thereof comprises a light chain variable region comprising an amino acid sequence that has at least 90% sequence identity to any one of SEQ ID NOs: 122-128, 316-320, 437-447, and 463.

5. The isolated antibody of claim 1, wherein the antibody or antigen-binding portion thereof comprises:
   (a) a heavy chain variable region comprising an amino acid sequence that has at least 90% sequence identity to any one of SEQ ID NOs:23-28, 310-315, 448-462, and 464-465; and
   (b) a light chain variable region comprising an amino acid sequence that has at least 90% sequence identity to any one of SEQ ID NOs: 122-128, 316-320, 437-447, and 463.

6. The isolated antibody of claim 5, wherein the antibody or antigen-binding portion thereof comprises:
   (a) a heavy chain variable region comprising an amino acid sequence that has at least 90% sequence identity to SEQ ID NO:23 and a light chain variable region comprising an amino acid sequence that has at least 90% sequence identity to SEQ ID NO:122; or
   (b) a heavy chain variable region comprising an amino acid sequence that has at least 90% sequence identity to SEQ ID NO:28 and a light chain variable region comprising an amino acid sequence that has at least 90% sequence identity to SEQ ID NO: 128; or
   (c) a heavy chain variable region comprising an amino acid sequence that has at least 90% sequence identity to SEQ ID NO:464 and a light chain variable region comprising an amino acid sequence that has at least 90% sequence identity to SEQ ID NO:463; or
   (d) a heavy chain variable region comprising an amino acid sequence that has at least 90% sequence identity to SEQ ID NO:465 and a light chain variable region comprising an amino acid sequence that has at least 90% sequence identity to SEQ ID NO:463.

7. The isolated antibody of claim 1, wherein the antibody or antigen-binding portion thereof comprises:
   (a) a heavy chain variable region comprising (i) an amino acid sequence that has at least 75% sequence identity to SEQ ID NO:23, and (ii) a CDR-H1, CDR-H2, and CDR-H3 that is identical to SEQ ID NOs:47, 72, and 99, respectively; or
   (b) a heavy chain variable region comprising (i) an amino acid sequence that has at least 75% sequence identity to SEQ ID NO:24, and (ii) a CDR-H1, CDR-H2, and CDR-H3 that is identical to SEQ ID NOs:48, 73, and 99, respectively; or
   (c) a heavy chain variable region comprising (i) an amino acid sequence that has at least 75% sequence identity to SEQ ID NO:25, and (ii) a CDR-H1, CDR-H2, and CDR-H3 that is identical to SEQ ID NOs:49, 74, and 99, respectively; or
   (d) a heavy chain variable region comprising (i) an amino acid sequence that has at least 75% sequence identity to SEQ ID NO:26, and (ii) a CDR-H1, CDR-H2, and CDR-H3 that is identical to SEQ ID NOs:48, 75, and 99, respectively; or (e) a heavy chain variable region comprising (i) an amino acid sequence that has at least 75% sequence identity to SEQ ID NO:27, and (ii) a CDR-H1, CDR-H2, and CDR-H3 that is identical to SEQ ID NOs:48, 76, and 99, respectively; or
(f) a heavy chain variable region comprising (i) an amino acid sequence that has at least 75% sequence identity to SEQ ID NO:28, and (ii) a CDR-H1, CDR-H2, and CDR-H3 that is identical to SEQ ID NOs:50, 77, and 100, respectively; or
(g) a heavy chain variable region comprising (i) an amino acid sequence that has at least 75% sequence identity to SEQ ID NO:310, and (ii) a CDR-H1, CDR-H2, and CDR-H3 that is identical to SEQ ID NOs:47, 72, and 99, respectively; or
(h) a heavy chain variable region comprising (i) an amino acid sequence that has at least 75% sequence identity to SEQ ID NO:311, and (ii) a CDR-H1, CDR-H2, and CDR-H3 that is identical to SEQ ID NOs:47, 72, and 99, respectively; or
(i) a heavy chain variable region comprising (i) an amino acid sequence that has at least 75% sequence identity to SEQ ID NO:312, and (ii) a CDR-H1, CDR-H2, and CDR-H3 that is identical to SEQ ID NOs:47, 72, and 99, respectively; or
(j) a heavy chain variable region comprising (i) an amino acid sequence that has at least 75% sequence identity to SEQ ID NO:313, and (ii) a CDR-H1, CDR-H2, and CDR-H3 that is identical to SEQ ID NOs:47, 72, and 99, respectively; or
(k) a heavy chain variable region comprising (i) an amino acid sequence that has at least 75% sequence identity to SEQ ID NO:314, and (ii) a CDR-H1, CDR-H2, and CDR-H3 that is identical to SEQ ID NOs:47, 72, and 99, respectively; or
(l) a heavy chain variable region comprising (i) an amino acid sequence that has at least 75% sequence identity to SEQ ID NO:315, and (ii) a CDR-H1, CDR-H2, and CDR-H3 that is identical to SEQ ID NOs:47, 72, and 99, respectively; or
(m) a heavy chain variable region comprising (i) an amino acid sequence that has at least 75% sequence identity to SEQ ID NO:448, and (ii) a CDR-H1, CDR-H2, and CDR-H3 that is identical to SEQ ID NOs:409, 72, and 99, respectively; or
(n) a heavy chain variable region comprising (i) an amino acid sequence that has at least 75% sequence identity to SEQ ID NO:449, and (ii) a CDR-H1, CDR-H2, and CDR-H3 that is identical to SEQ ID NOs:410, 72, and 99, respectively; or
(o) a heavy chain variable region comprising (i) an amino acid sequence that has at least 75% sequence identity to SEQ ID NO:450, and (ii) a CDR-H1, CDR-H2, and CDR-H3 that is identical to SEQ ID NOs:411, 72, and 99, respectively; or
(p) a heavy chain variable region comprising (i) an amino acid sequence that has at least 75% sequence identity to SEQ ID NO:451, and (ii) a CDR-H1, CDR-H2, and CDR-H3 that is identical to SEQ ID NOs:412, 72, and 99, respectively; or
(q) a heavy chain variable region comprising (i) an amino acid sequence that has at least 75% sequence identity to SEQ ID NO:452, and (ii) a CDR-H1, CDR-H2, and CDR-H3 that is identical to SEQ ID NOs:47, 415, and 99, respectively; or
(r) a heavy chain variable region comprising (i) an amino acid sequence that has at least 75% sequence identity to SEQ ID NO:453, and (ii) a CDR-H1, CDR-H2, and CDR-H3 that is identical to SEQ ID NOs:47, 416, and 99, respectively; or
(s) a heavy chain variable region comprising (i) an amino acid sequence that has at least 75% sequence identity to SEQ ID NO:454, and (ii) a CDR-H1, CDR-H2, and CDR-H3 that is identical to SEQ ID NOs:47, 417, and 99, respectively; or
(t) a heavy chain variable region comprising (i) an amino acid sequence that has at least 75% sequence identity to SEQ ID NO:455, and (ii) a CDR-H1, CDR-H2, and CDR-H3 that is identical to SEQ ID NOs:47, 418, and 99, respectively; or
(u) a heavy chain variable region comprising (i) an amino acid sequence that has at least 75% sequence identity to SEQ ID NO:456, and (ii) a CDR-H1, CDR-H2, and CDR-H3 that is identical to SEQ ID NOs:47, 419, and 99, respectively; or
(v) a heavy chain variable region comprising (i) an amino acid sequence that has at least 75% sequence identity to SEQ ID NO:457, and (ii) a CDR-H1, CDR-H2, and CDR-H3 that is identical to SEQ ID NOs:47, 72, and 100, respectively; or
(w) a heavy chain variable region comprising (i) an amino acid sequence that has at least 75% sequence identity to SEQ ID NO:458, and (ii) a CDR-H1, CDR-H2, and CDR-H3 that is identical to SEQ ID NOs:47, 72, and 423, respectively; or
(x) a heavy chain variable region comprising (i) an amino acid sequence that has at least 75% sequence identity to SEQ ID NO:459, and (ii) a CDR-H1, CDR-H2, and CDR-H3 that is identical to SEQ ID NOs:47, 72, and 424, respectively; or
(y) a heavy chain variable region comprising (i) an amino acid sequence that has at least 75% sequence identity to SEQ ID NO:460, and (ii) a CDR-H1, CDR-H2, and CDR-H3 that is identical to SEQ ID NOs:47, 72, and 425, respectively; or
(z) a heavy chain variable region comprising (i) an amino acid sequence that has at least 75% sequence identity to SEQ ID NO:461, and (ii) a CDR-H1, CDR-H2, and CDR-H3 that is identical to SEQ ID NOs:47, 72, and 426, respectively; or
(aa) a heavy chain variable region comprising (i) an amino acid sequence that has at least 75% sequence identity to SEQ ID NO:462, and (ii) a CDR-H1, CDR-H2, and CDR-H3 that is identical to SEQ ID NOs:47, 72, and 427, respectively; or
(ab) a heavy chain variable region comprising (i) an amino acid sequence that has at least 75% sequence identity to SEQ ID NO:464, and (ii) a CDR-H1, CDR-H2, and CDR-H3 that is identical to SEQ ID NOs:47, 416, and 425, respectively; or
(ac) a heavy chain variable region comprising (i) an amino acid sequence that has at least 75% sequence identity to SEQ ID NO:465, and (ii) a CDR-H1, CDR-H2, and CDR-H3 that is identical to SEQ ID NOs:47, 420, and 425, respectively.

8. The isolated antibody of claim 1, wherein the antibody or antigen-binding portion thereof comprises:
(a) a light chain variable region comprising (i) an amino acid sequence that has at least 75% sequence identity to SEQ ID NO:122, and (ii) a CDR-L1, CDR-L2, and CDR-L3 that is identical to SEQ ID NOs:143, 146, and 159, respectively; or
(b) a light chain variable region comprising (i) an amino acid sequence that has at least 75% sequence identity to SEQ ID NO:123, and (ii) a CDR-L1, CDR-L2, and CDR-L3 that is identical to SEQ ID NOs:138, 146, and 177, respectively; or
(c) a light chain variable region comprising (i) an amino acid sequence that has at least 75% sequence identity to SEQ ID NO:124, and (ii) a CDR-L1, CDR-L2, and CDR-L3 that is identical to SEQ ID NOs:138, 157, and 159, respectively; or
(d) a light chain variable region comprising (i) an amino acid sequence that has at least 75% sequence identity to SEQ ID NO:125, and (ii) a CDR-L1, CDR-L2, and CDR-L3 that is identical to SEQ ID NOs:138, 152, and 159, respectively; or
(e) a light chain variable region comprising (i) an amino acid sequence that has at least 75% sequence identity to SEQ ID NO:126, and (ii) a CDR-L1, CDR-L2, and CDR-L3 that is identical to SEQ ID NOs:138, 146, and 159, respectively; or
(f) a light chain variable region comprising (i) an amino acid sequence that has at least 75% sequence identity to SEQ ID NO:127, and (ii) a CDR-L1, CDR-L2, and CDR-L3 that is identical to SEQ ID NOs:130, 146, and 159, respectively; or
(g) a light chain variable region comprising (i) an amino acid sequence that has at least 75% sequence identity to SEQ ID NO:128, and (ii) a CDR-L1, CDR-L2, and CDR-L3 that is identical to SEQ ID NOs:144, 146, and 159, respectively; or
(h) a light chain variable region comprising (i) an amino acid sequence that has at least 75% sequence identity to SEQ ID NO:316, and (ii) a CDR-L1, CDR-L2, and CDR-L3 that is identical to SEQ ID NOs:143, 146, and 159, respectively; or
(i) a light chain variable region comprising (i) an amino acid sequence that has at least 75% sequence identity to SEQ ID NO:317, and (ii) a CDR-L1, CDR-L2, and CDR-L3 that is identical to SEQ ID NOs:143, 146, and 159, respectively; or
(j) a light chain variable region comprising (i) an amino acid sequence that has at least 75% sequence identity to SEQ ID NO:318, and (ii) a CDR-L1, CDR-L2, and CDR-L3 that is identical to SEQ ID NOs:143, 146, and 159, respectively; or
(k) a light chain variable region comprising (i) an amino acid sequence that has at least 75% sequence identity to SEQ ID NO:319, and (ii) a CDR-L1, CDR-L2, and CDR-L3 that is identical to SEQ ID NOs:143, 146, and 159, respectively; or
(l) a light chain variable region comprising (i) an amino acid sequence that has at least 75% sequence identity to SEQ ID NO:320, and (ii) a CDR-L1, CDR-L2, and CDR-L3 that is identical to SEQ ID NOs:143, 146, and 159, respectively; or
(m) a light chain variable region comprising (i) an amino acid sequence that has at least 75% sequence identity to SEQ ID NO:437, and (ii) a CDR-L1, CDR-L2, and CDR-L3 that is identical to SEQ ID NOs:143, 395, and 159, respectively; or
(n) a light chain variable region comprising (i) an amino acid sequence that has at least 75% sequence identity to SEQ ID NO:438, and (ii) a CDR-L1, CDR-L2, and CDR-L3 that is identical to SEQ ID NOs:143, 396, and 159, respectively; or
(o) a light chain variable region comprising (i) an amino acid sequence that has at least 75% sequence identity to SEQ ID NO:439, and (ii) a CDR-L1, CDR-L2, and CDR-L3 that is identical to SEQ ID NOs:143, 397, and 159, respectively; or
(p) a light chain variable region comprising (i) an amino acid sequence that has at least 75% sequence identity to SEQ ID NO:440, and (ii) a CDR-L1, CDR-L2, and CDR-L3 that is identical to SEQ ID NOs:143, 398, and 159, respectively; or
(q) a light chain variable region comprising (i) an amino acid sequence that has at least 75% sequence identity to SEQ ID NO:441, and (ii) a CDR-L1, CDR-L2, and CDR-L3 that is identical to SEQ ID NOs:143, 399, and 159, respectively; or
(r) a light chain variable region comprising (i) an amino acid sequence that has at least 75% sequence identity to SEQ ID NO:442, and (ii) a CDR-L1, CDR-L2, and CDR-L3 that is identical to SEQ ID NOs:143, 400, and 159, respectively; or
(s) a light chain variable region comprising (i) an amino acid sequence that has at least 75% sequence identity to SEQ ID NO:443, and (ii) a CDR-L1, CDR-L2, and CDR-L3 that is identical to SEQ ID NOs:143, 146, and 167, respectively; or
(t) a light chain variable region comprising (i) an amino acid sequence that has at least 75% sequence identity to SEQ ID NO:444, and (ii) a CDR-L1, CDR-L2, and CDR-L3 that is identical to SEQ ID NOs:143, 146, and 403, respectively; or
(u) a light chain variable region comprising (i) an amino acid sequence that has at least 75% sequence identity to SEQ ID NO:445, and (ii) a CDR-L1, CDR-L2, and CDR-L3 that is identical to SEQ ID NOs:143, 146, and 404, respectively; or
(v) a light chain variable region comprising 75% sequence identity to SEQ ID NO:446, and (ii) a CDR-L1, CDR-L2, and CDR-L3 that is identical to SEQ ID NOs:143, 146, and 405, respectively; or
(w) a light chain variable region comprising (i) an amino acid sequence that has at least 75% sequence identity to SEQ ID NO:447, and (ii) a CDR-L1, CDR-L2, and CDR-L3 that is identical to SEQ ID NOs:143, 146, and 406, respectively; or
(x) a light chain variable region comprising (i) an amino acid sequence that has at least 75% sequence identity to SEQ ID NO:463, and (ii) a CDR-L1, CDR-L2, and CDR-L3 that is identical to SEQ ID NOs: 143, 395, and 405, respectively.

9. The isolated antibody of claim 1, comprising:
(a) a heavy chain CDR1 comprising the amino acid sequence of SEQ ID NO:47;
(b) a heavy chain CDR2 comprising the amino acid sequence of SEQ ID NO:72; and
(c) a heavy chain CDR3 comprising the amino acid sequence of SEQ ID NO:99.

10. The isolated antibody of claim 1, comprising:
(a) a light chain CDR1 comprising the amino acid sequence of SEQ ID NO:143;
(b) a light chain CDR2 comprising the amino acid sequence of SEQ ID NO:146; and
(c) a light chain CDR3 comprising the amino acid sequence of SEQ ID NO:159.

11. The isolated antibody of claim 1, comprising:
(a) a heavy chain CDR1 comprising the amino acid sequence of SEQ ID NO:47;
(b) a heavy chain CDR2 comprising the amino acid sequence of SEQ ID NO:416; and (c) a heavy chain CDR3 comprising the amino acid sequence of SEQ ID NO:425.

12. The isolated antibody of claim 1, comprising:
(a) a light chain CDR1 comprising the amino acid sequence of SEQ ID NO:143;
(b) a light chain CDR2 comprising the amino acid sequence of SEQ ID NO:395; and
(c) a light chain CDR3 comprising the amino acid sequence of SEQ ID NO:405.

13. The isolated antibody of claim 1, comprising a heavy chain CDR1 comprising the amino acid sequence of SEQ ID NO:47, a heavy chain CDR2 comprising the amino acid sequence of SEQ ID NO:416, a heavy chain CDR3 comprising the amino acid sequence of SEQ ID NO:425, a light chain CDR1 comprising the amino acid sequence of SEQ ID NO:143, a light chain CDR2 comprising the amino acid sequence of SEQ ID NO:395, and a light chain CDR3 comprising the amino acid sequence of SEQ ID NO:405.

14. The isolated antibody of claim 5, wherein the antibody or antigen-binding portion thereof comprises a heavy chain variable region comprising an amino acid sequence that has at least 90% sequence identity to SEQ ID NO:464 and a light chain variable region comprising an amino acid sequence that has at least 90% sequence identity to SEQ ID NO:463.

15. The isolated antibody of claim 14, wherein the antibody or antigen-binding portion thereof comprises a heavy chain variable region comprising the amino acid sequence of SEQ ID NO:464 and a light chain variable region comprising the amino acid sequence of SEQ ID NO:463.

16. The isolated antibody of claim 1, wherein the antibody or antigen-binding portion thereof specifically binds to the human BACE1 protein with a binding affinity of less than about 75 nM.

17. The isolated antibody of claim 1, wherein the antibody is a monoclonal antibody, a chimeric antibody, or a humanized antibody.

18. A pharmaceutical composition comprising the isolated antibody of claim 1 and a pharmaceutically acceptable carrier.

19. An isolated polynucleotide comprising a nucleotide sequence encoding the isolated antibody of claim 1.

20. An isolated humanized antibody or antigen-binding portion thereof that specifically binds to a human BACE1 protein, wherein the antibody or antigen-binding portion thereof comprises:
(a) a heavy chain variable region comprising the amino acid sequence of any one of SEQ ID NOs:310-315, 448-462, and 464-465; and
(b) a light chain variable region comprising the amino acid sequence of any one of SEQ ID NOs:316-320, 437-447, and 463.

21. A pharmaceutical composition comprising the humanized antibody of claim 20 and a pharmaceutically acceptable carrier.

22. An isolated polynucleotide comprising a nucleotide sequence encoding the humanized antibody of claim 20.

* * * * *